(12) United States Patent
Hofmeister et al.

(10) Patent No.: US 8,076,459 B2
(45) Date of Patent: Dec. 13, 2011

(54) MULTISPECFIC DEIMMUNIZED CD3-BINDERS

(75) Inventors: Robert Hofmeister, Germering (DE); Birgit Kohleisen, München (DE); Ulla Lenkkeri-Schütz, Eching (DE); Christian Itin, Gräfelfing (DE); Patrick Bäuerle, Gauting (DE); Francis J. Carr, Aberdeenshire (GB); Anita A. Hamilton, Aberdeen (GB); Stephen Williams, Aberdeenshire (GB)

(73) Assignee: Micromet AG, Munich (DE)

( * ) Notice: Subject to any disclaimer, the term of this patent is extended or adjusted under 35 U.S.C. 154(b) by 1319 days.

(21) Appl. No.: 10/572,740

(22) PCT Filed: Oct. 15, 2004

(86) PCT No.: PCT/EP2004/011646
§ 371 (c)(1),
(2), (4) Date: Dec. 4, 2006

(87) PCT Pub. No.: WO2005/040220
PCT Pub. Date: May 6, 2005

(65) Prior Publication Data
US 2009/0022738 A1    Jan. 22, 2009

(30) Foreign Application Priority Data
Oct. 16, 2003  (EP) .................................. 03023581

(51) Int. Cl.
| C12P 21/08 | (2006.01) |
| C12P 21/04 | (2006.01) |
| C07H 21/04 | (2006.01) |
| C12Q 1/68  | (2006.01) |
| G01N 33/53 | (2006.01) |
| C12N 15/00 | (2006.01) |
| A61K 39/00 | (2006.01) |

(52) U.S. Cl. ....... 530/387.3; 536/23.53; 435/6; 435/7.1; 435/69.6; 435/320.1; 424/133.1

(58) Field of Classification Search .................. None
See application file for complete search history.

(56) References Cited

U.S. PATENT DOCUMENTS

| 4,361,549 | A    |   | 11/1982 | Kung et al. |           |
| 5,929,212 | A    | * | 7/1999  | Jolliffe et al. | 530/387.3 |
| 6,491,916 | B1   |   | 12/2002 | Bluestone et al. |         |
| 7,235,641 | B2   | * | 6/2007  | Kufer et al.  | 530/387.3 |
| 7,635,472 | B2   | * | 12/2009 | Kufer et al.  | 424/130.1 |
| 2002/0009430 | A1 | * | 1/2002 | Lindhofer et al. | 424/93.7 |
| 2004/0162411 | A1 |   | 8/2004 | Lanzavecchia  |           |

FOREIGN PATENT DOCUMENTS

| EP | 0 620 276 A1 | 10/1994 |
| EP | 0620276 A  | 10/1994 |
| WO | WO 92/10755 A1 | 6/1992 |
| WO | WO 92 15683 | * 9/1992 |
| WO | WO 98/52976 A1 | 11/1998 |
| WO | WO 99/54440 A | 10/1999 |
| WO | WO 99/54440 A1 | 10/1999 |
| WO | WO 00/34317 A2 | 6/2000 |
| WO | WO 02/012899 A2 | 2/2002 |
| WO | WO 02/066514 A | 8/2002 |
| WO | WO 02/066514 A2 | 8/2002 |
| WO | WO 02/069232 A2 | 9/2002 |
| WO | WO 0269232 A2 | * 9/2002 |
| WO | WO 02/079415 A2 | 10/2002 |

OTHER PUBLICATIONS

Paul. Fundamental Immunology, 3rd Edition, 1993. pp. 292-295.*
Rudikoff, Giusti, Cook, and Scharff. Single amino acid substitution altering antigen-binding specificity. Proceedings of the National Academy of Sciences, 1982. vol. 79, pp. 1979-1983.*
Colman. Effects of amino acid sequence changes on antibody-antigen interactions. Research in Immunology, 1994. vol. 145, pp. 33-36.*
Mac Callum, Martin and Thornton. Antibody-antigen interactions: contact analysis and binding site topography. Journal of Molecular Biology, 1996. vol. 262, pp. 732-745.*
De Pascalis, Iwahashi, Tamura, Padlan, Gonzales, Santos, Giuliano, Schuck, Schlom, and Kashmiri. Grafting of abbreviated complementarity determining regions containing specificity determining residues essential for ligand contact to engineer a less immunogenic humanzied monoclonal antibody. Journal of Immunology, 2002. vol. 169, pp. 3076-3084.*
Casset, Roux, Mouchet, Bes, Chardes, Granier, Mani, Pugniere, Laune, Pau, Kaczorek, Lahana, and Rees. A peptide mimetic of an anti-CD4 monoclonal antibody by rational design. Biochemical and Biophysical Research Communications, 2003. vol. 307, pp. 198-205.*
Vajdos, Adams, Breece, Presta, De Vos, and Sidhu. Comprehensive functional maps of the antigen-binding site of an anti-ErbB2 antibody obtained with shotgun scanning mutagenesis. Journal of Molecular Biology, 2002. vol. 320, pp. 415-428.*
Holm, Jafari, and Sundstrom. Functional mapping and single chain construction of the anti-cytokeratin 8 monoclonal antibody TS1. Molecular Immunology, 2007. vol. 44, pp. 1075-1084.*
Chen, Wiesmann, Fuh, Li, Christinger, Mc Kay, De Vos, and Lowman. Selection and analysis of an optimized anti-VEGF antibody: crystal structure of an affinity matured Fab in complex with antigen. Journal of Molecular Biology, 1999. vol. 293, pp. 865-881.*
Wu, Nie, Huse, and Watkins. Humanization of a murine monoclonal antibody by simultaneous optimization of framework and CDR residues. Journal of Molecular Biology, 1999. vol. 294, pp. 151-162.*

(Continued)

Primary Examiner — Anne M. Gussow
(74) Attorney, Agent, or Firm — Foley & Lardner LLP

(57) ABSTRACT

The present invention provides a cytotoxically active CD3 specific binding construct comprising a first domain specifically binding to human CD3 and an IG-derived second binding domain. Furthermore, a nucleic acid sequence encoding a CD3 specific binding construct is provided. Further aspects of the invention are vectors and host cells comprising the nucleic acid sequences, a process for the production of the construct and composition comprising the construct. The invention also provides the use of the constructs for the preparation of pharmaceutical compositions for the treatment of particular diseases, a method for the treatment of particular diseases and a kit comprising the binding construct of the invention.

31 Claims, 40 Drawing Sheets

OTHER PUBLICATIONS

Figure 7A:
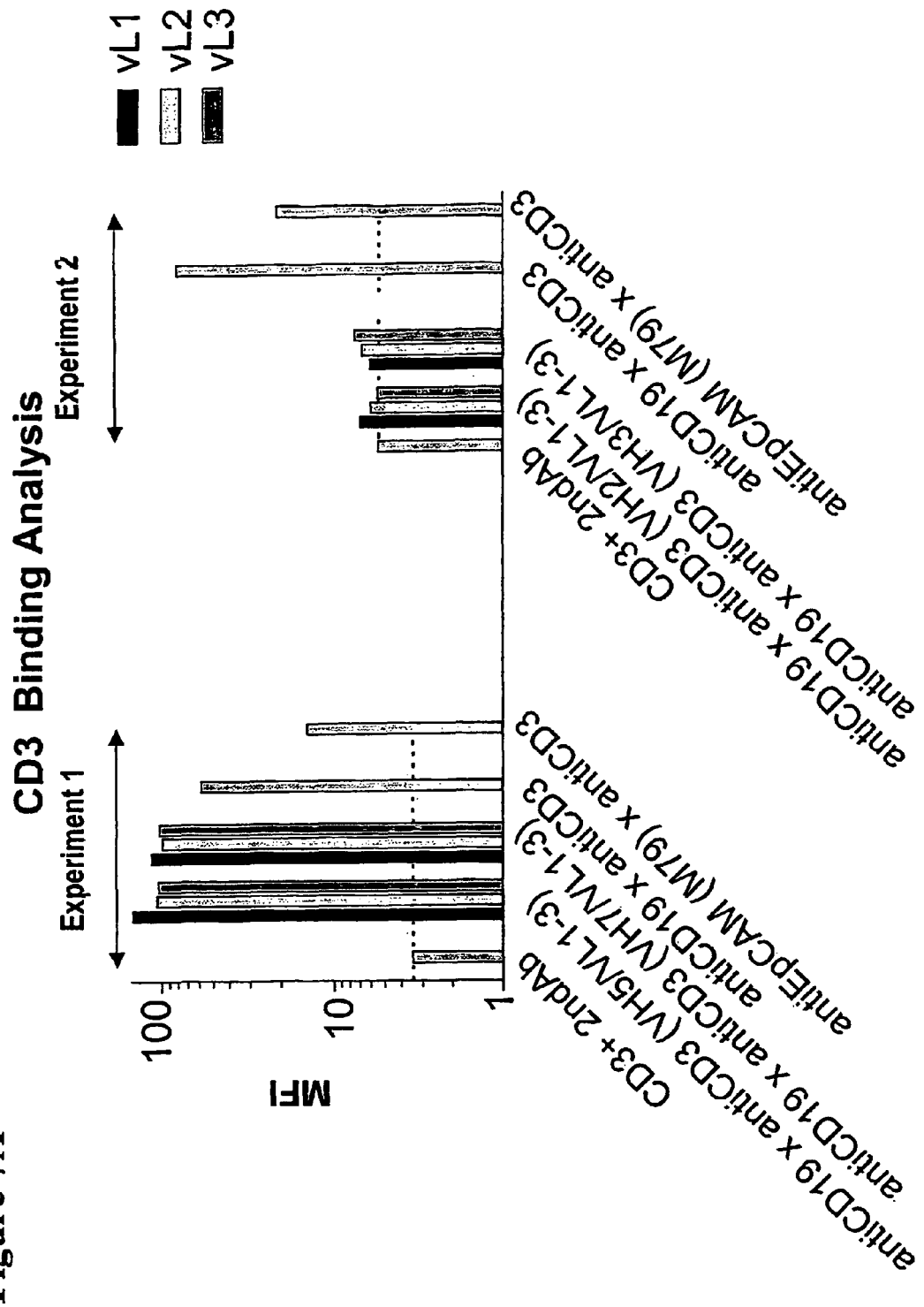

Granziero, Krajewski, Farness, Yuan, Courtney, Jackson, Peterson, and Vitiello. Adoptive immunotherapy prevents prostate cancer in a transgenic animal model. European Journal of Immunology, 1999. vol. 29, pp. 1127-1138.*

Byers. What can randomized controlled trials tell us about nutrition and cancer prevention? CA Cancer Journal, 1999. vol. 49, pp. 353-361.*

Skolnick and Fetrow. From genes to protein structure and function: novel application of computational approaches in the genomic era. Trends in Biotechnology, 2000. vol. 18, pp. 34-39.*

Burgess, Shaheen, Ravera, Jaye, Donohue, and Winkles. Possible dissociation of the heparin binding and mitogenic activities of heparin binding (acidic fibroblast) growth factor-1 from its receptor binding activities by site directed mutagenesis of a single lysine residue. Journal of Cell Biology, 1990. vol. 111, pp. 2129-2138.*

Lazar, Watanabe, Dalton, and Sporn. Transforming growth factor alpha: mutation of aspartic acid 47 and leucine 48 results in different biological activities. Molecular and Cellular Biology, 1988. vol. 8, pp. 1247-1252.*

Eck and Wilson. "Gene-based Therapy" Goodman & Gilman's The Pharmacological basis of Therapeutics, McGraw-Hill, New York, NY. 1996. pp. 77-101.*

Verma and Somia. Gene therapy- promises, problems, and prospects. Nature, 1997. vol. 389, pp. 239-242.*

Pfeifer and Verma. Gene therapy: promises and problems. Annual Review of Genomics and Human Genetics, 2001. vol. 2, pp. 177-211.*

Vile, Russell, and Lemoine. Cancer gene therapy: hard lessons and new courses. Gene Therapy, 2000, vol. 7 pp. 2-8.*

Kelland, et al. "Of mice and men": values and liabilities of the athymic nude mouse model in anticancer drug development. European Journal of Cancer, 2004. vol. 40, pp. 827-836.*

K. Maletz, et al., "Bispecific Single-Chain Antibodies As Effective Tools For Eliminating Epithelial Cancer Cells From Human Stem Cell Preparations by Redirected Cell Cytotoxicity," Int. J. Cancer, vol. 93, pp. 409-416 (2001).

The Notice of Reasons for Rejection received in the corresponding Japanese Patent Application No. 2006-534709, dated Jun. 7, 2010. (with translation).

Foote, et al., "Antibody Framework Residues Affecting the Conformation of the Hypervariable Loops", *J. Mol. Biol.*, 2002, vol. 224, pp. 487-499.

Maletz, et al., "Bispecific Single-Chain Antibodies as Effective Tools for Eliminating Epithelial Cancer Cells from Human Stem Cell Preparations by Redirected Cell Cytotoxicity", *Int. J. Cancer*, 2001, vol. 93, pp. 409-416.

Winter, et al., "Humanized antibodies", *Immunology Today*, 1993, vol. 14, No. 6, pp. 243-246.

Maletz, et. al., "Bispecific single-chain antibodies as effective tools for eliminating epithelial cancer cells from human stem cell preparations by redirected cell cytotoxicity", *International Journal of Cancer*, vol. 93, No. 3, Aug. 2001, pp. 409-416.

The European Search Report received in the related European Patent Application 10177720.9, dated Feb. 11, 2011.

* cited by examiner

Figure 1

Anti-CD3 WT

GATATCAAACTGCAGCAGTCAGGGGCTGAACTGGCAAGACCTGGGGCCTCAGTGAAGATGTCCT
GCAAGACTTCTGGCTACACCTTTACTAGGTACACGATGCACTGGGTAAAACAGAGGCCTGGACA
GGGTCTCGAATGGATTGGATACATTAATCCTAGCCGTGGTTATACTAATTACAATCAGAAGTTC
AAGGACAAGGCCACATTGACTACAGACAAATCCTCCAGCACAGCCTACATGCAACTGAGCAGCC
TGACATCTGAGGACTCTGCAGTCTATTACTGTGCAAGATATTATGATGATCATTACTGCCTTGA
CTACTGGGGCCAAGGCACCACTCTCACAGTCTCCTCAGGTGGAGGTGGAAGTGGAGGTTCTGGT
GGAAGTGGAGGTTCAGGTGGAGATCGAGTCAGCTGACCCAGTCTCCAGCAATCATGTCTCTG
CATCTCCAGGGGAGAAGGTCACCATGACCTGCAGAGCCAGTTCAAGTGTAAGTTACATGAACTG
GTACCAGCAGAAGTCAGGCACCTCCCCCAAAAGATGGATTTATGACACATCCAAAGTGGCTTCT
GGAGTCCCTTATCGCTTCAGTGGCAGTGGGTCTGGGACCTCTTATACTCTCACAATCAGCAGCA
TGGAGGCTGAAGATGCTGCCACTTATTACTGCCAACAGTGGAGTAGTAACCCGCTCACGTTCGG
TGCTGGGACCAAGCTGGAGCTGAAA

AA Sequence

DIKLQQSGAELARPGASVKMSCKTSGYTFTRYTMHWVKQRPGQGLEWIGYINPSRGYTNYNQKF
KDKATLTTDKSSSTAYMQLSSLTSEDSAVYYCARYYDDHYCLDYWGQGTTLTVSSVEGGSGGSG
GSGGSGGVDDIQLTQSPAIMSASPGEKVTMTCRASSSVSYMNWYQQKSGTSPKRWIYDTSKVAS
GVPYRFSGSGSGTSYSLTISSMEAEDAATYYCQQWSSNPLTFGAGTKLELK

Fig. 2A

VH2
DVQLVQSGAEVKKPGASVKVSCKASGYTATRYTMHWVRQAPGQGLEWIGYINPSRGYTNYAQKLQGRVTMTTDTSTSTAYMELSSLRSEDTATYYCARYDDHYCLDYWGQGTTVTVSS

VH3
DVQLVQSGAEVKKPGASVKVSCKASGYTATRYTMHWVRQAPGQGLEWIGYINPSRGYTNYAQKLQGRVTMTTDTSTSTAYLQMNSLKTEDTAVYYCARYDDHYCLDYWGQGTTVTVSS

VH5
DVQLVQSGAEVKKPGASVKVSCKASGYTFTRYTMHWVRQAPGQGLEWIGYINPSRGYTNYADSVKGRFTITTDKSTSTAYMELSSLRSEDTAVYYCARYDDHYCLDYWGQGTTVTVSS

VH7
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYDDHYCLDYWGQGTTVTVSS

Fig. 2 A (cont.)

VL1
DIQMTQSPSSLSASVGDRVTITCRASQSVSYMNWYQQKPGKAPKRWIYDT
SKVASGVPARFSGSGSGTDYSLTINSLEAEDAATYYCQQWSSNPLTFGGG
TKVEIK

VL2
DIVLTQSPATLSLSPGERATLSCRASQSVSYMNWYQQKPGKAPKRWIYDT
SKVASGVPARFSGSGSGTDYSLTINSLEAEDAATYYCQQWSSNPLTFGGG
TKVEIK

VL3
DIVLTQSPATLSLSPGERATLTCRASSSVSYMNWYQQKPGKAPKRWIYDT
SKVASGVPARFSGSGSGTDYSLTINSLEAEDAATYYCQQWSSNPLTFGGG
TKVEIK

Fig. 2B

VH2

GACGTCCAACTGGTGCAGTCAGGGGCTGAAGTGAAAAAACCTGGGGCCTCAGTGAAGGTGTCCTGC
AAGGCTTCTGGCTACACCGCTACTAGTACACGATGCACTGGGTAAGGCAGGCACCTGGACAGGGT
CTGGAATGGATTGGATACATTAATCCTAGCCGTGGTTATACTAATTACGCACAGAAGTTGCAGGGC
CGCGTCACAATGACTACAGACACTTCCACCAGCACACCTACATGGAACTGAGCAGCCTGCGTTCT
GAGGACACTGCAACCTATTACTGTGCAAGATATTATGATCATTACTGCCTTGACTACTGGGGC
CAAGGCACCACGGTCACCGTCTCCTCA

VH3

GACGTCCAACTGGTGCAGTCAGGGGCTGAAGTGAAAAAACCTGGGGCCTCAGTGAAGGTGTCCTGC
AAGGCTTCTGGCTACACCGCTACTAGTACACGATGCACTGGGTAAGGCAGGCACCTGGACAGGGT
CTGGAATGGATTGGATACATTAATCCTAGCCGTGGTTATACTAATTACGCACAGAAGTTGCAGGGC
CGCGTCACAATGACTACAGACACTTCCACCAGCACCTACCTGCAAATGAACAGCCTGAAAACT
GAGGACACTGCAGTCTATTACTGTGCAAGATATTATGATCATTACTGCCTTGACTACTGGGGC
CAAGGCACCACGGTCACCGTCTCCTCA

VH5

GACGTCCAACTGGTGCAGTCAGGGGCTGAAGTGAAAAAACCTGGGGCCTCAGTGAAGGTGTCCTGC
AAGGCTTCTGGCTACACCTTTACTAGTACACGATGCACTGGGTAAGGCAGGCACCTGGACAGGGT
CTGGAATGGATTGGATACATTAATCTAATTACTAATTACGCAGACAGCGTCAAGGGC
CGCTTCACAATCACTACAGACAAATCCACCAGCCTACAGCCTACACCTACACAGAGCCTGCGTTCT
GAGGACACTGCAACCTATTACTGTGCAAGATATTATGATCATTACTGCCTTGACTACTGGGGC
CAAGGCACCACGGTCACCGTCTCCTCA

Fig. 2 B (cont.)

VH7
GACGTCCAACTGGTGCAGTCAGGGGCTGAAGTGAAAAAACCTGGGGCCTCAGTGAAGGTGTCCTGC
AAGGCTTCTGGCTACACCTTTACTAGGTACACGATGCACTGGGTAAGGCAGGCACCTGGACAGGGT
CTGGAATGGATTGGATACATTAATCCTAGCCGTGGTTATACTAATTACAATCAGAAGTTCAAGGAC
CGCGTCACAATCACTACAGACAAATCCACCAGCACCTACATGGAACTGAGCAGCCTGCGTTCT
GAGGACACTGCAGTCTATTACTGTGCAAGATATTATGATCATTACTGCCTTGACTACTGGGGC
CAAGGCACCACGGTCACCGTCTCCTCA

Fig. 2 B (cont.)

vL1

GACATTCAGATGACCCAGTCTCCATCTAGCCTGTCTGCATCTGTCGGGGACCGTGTCACCATCACC
TGCAGAGCCAGTCAGTCAAAGTGTACATGAACTGGTACCAGCAGAAACCCGGGCAAGCCACCCAAA
AGATGGATTTATGACACATCCAAAGTGGCTTCTGGAGTCCCTGCTTCAGTGGCAGTGGGTCT
GGGACCGACTACTCTCTCACAATCAACAGCTTGGAGGCTGAAGATGCTGCCACTTATTACTGCCAA
CAGTGGAGTAGTAACCCGCTCACGTTCGGTGGCGGGGACCAAGGT vL2

GACATTGTACTGACCCAGTCTCCAGCAACTCTGTCTCTCCAGGGGAGCCGTGCCACCCTGAGC
TGCAGAGCCAGTCAGTCAAGTGTAAGTTACATGAACTGGTACCAGCAGAAGCCGGGCAAGCCACCCAAA
AGATGGATTTATGACACATCCAAAGTGGCTTCTGGAGTCCCTGCTTCAGTGGCAGTGGGTCT
GGGACCGACTACTCTCTCACAATCAACAGCTTGGAGGCTGAAGATGCTGCCACTTATTACTGCCAA
CAGTGGAGTAGTAACCCGCTCACGTTCGGTGGCGGGGACCAAGGTGGAGATCAAA vL3

GACATTGTACTGACCCAGTCTCCAGCAACTCTGTCTCTGTCTCCAGGGGAGCCGTGCCACCCTGACC
TGCAGAGCCAGTCAAGTGTAAGTTACATGAACTGGTACCAGCAGAAGCCGGGCAAGCCACCCAAA
AGATGGATTTATGACACTCTCTCACAATCAAACAGCTTGGAGTCCCTGCTTCAGTGGCAGTGGGTCT
GGGACCGACTACTCTCTCACAATCAACAGCTTGGAGGCTGAAGATGCTGCCACTTATTACTGCCAA
CAGTGGAGTAGTAACCCGCTCACGTTCGGTGGCGGGGACCAAGGTGGAGATCAAA

Fig. 2 C vH CDR1
| | |
|---|---|
| Wt anti-CD3 | GYTFTRYTMH |
| VH2,3 | GYTATRYTMH |
| VH5,7 | GYTFTRYTMH | vH CDR2
| | |
|---|---|
| WT anti-CD3, VH7 | YINPSRGYTNYNQKFKD |
| VH5 | YINPSRGYTNYADSVKG |
| VH2, 3 | YINPSRGYTNYAQKLQG | vH CDR3
| | |
|---|---|
| WT anti-CD3, VH2, 3, 5, 7 | YYDDHYCLDY | vK CDR1
| | |
|---|---|
| WT anti-CD3, VL3 | RASSSVSYMN |
| VL1, 2 | RASQSVSYMN | vK CDR2
| | |
|---|---|
| WT anti-CD3, VL1, 2, 3 | DTSKVAS | vK CDR3
| | |
|---|---|
| WT anti-CD3, VL1, 2, 3 | QQWSSNPLT |

Fig. 2 D vH CDR1

| | |
|---|---|
| WT anti-CD3 | GGCTACACCTTTACTAGGTACACGATGCAC |
| VH2,3 | GGCTACACCGCTACTAGGTACACGATGCAC |
| VH5,7 | GGCTACACCTTTACTAGGTACACGATGCAC | vH CDR2

| | |
|---|---|
| WT anti-CD3, VH7 | TACATTAATCCTAGCCGTGGTTATACTAATTACAATCAGAAGTTCAAGGAC |
| VH5 | TACATTAATCCTAGCCGTGGTTATACTAATTACGCAGACAGCGTCAAGGGC |
| VH2,3 | TACATTAATCCTAGCCGTGGTTATACTAATTACGCACAGAAGTTGCAGGGC |

VH CDR3

| | |
|---|---|
| WT anti-CD3, VH2, 3, VH5, 7 | TATTATGATGATCATTACTGCCTTGACTAC |

Fig. 2 D (cont.)

vK CDR1

WT anti-CD3,
VL3           AGAGCCAGTTCAAGTGTAAGTTACATGAAC

VL1, 2        AGAGCCAGTCAAAGTGTAAGTTACATGAAC vK CDR2

WT anti-CD3,
VL1-3         ACACATCCAAAGTGGCTTCT

VK CDR3

WT anti-CD3,
VL1-3         CAACAGTGGAGTAGTAACCCGCTCACG

Figure 3

A) anti-CD3(VH2/VL1)

GACGTCCAACTGGTGCAGTCAGGGGCTGAAGTGAAAAAACC
TGGGGCCTCAGTGAAGGTGTCCTGCAAGGCTTCTGGCTACA
CCGCTACTAGGTACACGATGCACTGGGTAAGGCAGGCACCT
GGACAGGGTCTGGAATGGATTGGATACATTAATCCTAGCCG
TGGTTATACTAATTACGCACAGAAGTTGCAGGGCCGCGTCA
CAATGACTACAGACACTTCCACCAGCACAGCCTACATGGAA
CTGAGCAGCCTGCGTTCTGAGGACACTGCAACCTATTACTG
TGCAAGATATTATGATGATCATTACTGCCTTGACTACTGGG
GCCAAGGCACCACGGTCACCGTCTCCTCAGGCGAAGGTACT
AGTACTGGTTCTGGTGGAAGTGGAGGTTCAGGTGGAGCAGA
CGACATTCAGATGACCCAGTCTCCATCTAGCCTGTCTGCAT
CTGTCGGGGACCGTGTCACCATCACCTGCAGAGCCAGTCAA
AGTGTAAGTTACATGAACTGGTACCAGCAGAAGCCGGGCAA
GGCACCCAAAAGATGGATTTATGACACATCCAAAGTGGCTT
CTGGAGTCCCTGCTCGCTTCAGTGGCAGTGGGTCTGGGACC
GACTACTCTCTCACAATCAACAGCTTGGAGGCTGAAGATGC
TGCCACTTATTACTGCCAACAGTGGAGTAGTAACCCGCTCA
CGTTCGGTGGCGGGACCAAGGTGGAGATCAAA

B) anti-CD3(VH2/VL1)

DVQLVQSGAEVKKPGASVKVSCKASGYTATRYTMHWVRQAP
GQGLEWIGYINPSRGYTNYAQKLQGRVTMTTDTSTSTAYME
LSSLRSEDTATYYCARYYDDHYCLDYWGQGTTVTVSSGEGT
STGSGGSGGSGGADDIQMTQSPSSLSASVGDRVTITCRASQ
SVSYMNWYQQKPGKAPKRWIYDTSKVASGVPARFSGSGSGT
DYSLTINSLEAEDAATYYCQQWSSNPLTFGGGTKVEIK

Figure 3

C) anti-CD3(VH2/VL2)

GACGTCCAACTGGTGCAGTCAGGGGCTGAAGTGAAAA-
AACCTGGGGCCTCAGTGAAGGTGTCCTG-
CAAGGCTTCTGGCTACACCGCTACTAGGTACACGATG-
CACTGGGTAAGGCAGGCACCTGGACAGGGTCTGGAATGGAT
TGGATACATTAATCCTAGCCGTGGTTATACTAATTACGCA-
CAGAAGTTGCAGGGCCGCGTCACAATGACTACAGA-
CACTTCCACCAGCACAGCCTACATGGAACTGAG-
CAGCCTGCGTTCTGAGGACACTGCAACCTATTACTGTGCAA
GATATTATGATGATCATTACTGCCTTGACTACGGGGC-
CAAGGCACCACGGTCACCGTCTCCTCAGGCGAAGGTAC-
TAGTACTGGTTCTGGTGGAAGTGGAGGTTCAGGTGGAGCA-
GACGACATTGTACTGACCCAGTCTCCAGCAACTCTGTCTCT
GTCTCCAGGGGAGCGTGCCACCCTGAGCTGCAGAGCCAGT-
CAAAGTGTAAGTTACATGAACTGGTACCAGCA-
GAAGCCGGGCAAGGCACCCAAAAGATGGATTTATGACA-
CATCCAAAGTGGCTTCTGGAGTCCCTGCTCGCTTCAGTGGC
AGTGGGTCTGGGACCGACTACTCTCTCACAATCAA-
CAGCTTGGAGGCTGAAGATGCTGCCACTTATTACTGCCAA-
CAGTGGAGTAGTAACCCGCTCACGTTCGGTGGCGGGAC-
CAAGGTGGAGATCAAA

D) anti-CD3(VH2/VL2)

DVQLVQSGAEVKKPGASVKVSCKASGYTATRYTMHWVR-
QAPGQGLEWIGYINPSRGYTNY-
AQKLQGRVTMTTDTSTSTAYMELSSLRSEDTATYYCA-
RYYDDHYCLDYWGQGTTVTVSSGEGTSTGSGGSGGSGGADD
IVLTQSPATLSLSPGERATLSCRASQSVSYMNWYQQKPG-
KAPKRWIYDTSKVASGVPARFSGSGSGTDYSLTINSLEAE-
DAATYYCQQWSSNPLTFGGGTKVEIK

Figure 3

E) anti-CD3(VH2/VL3)

GACGTCCAACTGGTGCAGTCAGGGGCTGAAGTGAAAA-
AACCTGGGGCCTCAGTGAAGGTGTCCTG-
CAAGGCTTCTGGCTACACCGCTACTAGGTACACGATG-
CACTGGGTAAGGCAGGCACCTGGACAGGGTCTGGAATGGAT
TGGATACATTAATCCTAGCCGTGGTTATACTAATTACGCA
CAGAAGTTGCAGGGCCGCGTCACAATGACTACAGA-
CACTTCCACCAGCACAGCCTACATGGAACTGAG-
CAGCCTGCGTTCTGAGGACACTGCAACCTATTACTGTGCAA
GATATTATGATGATCATTACTGCCTTGACTACTGGGGC-
CAAGGCACCACGGTCACCGTCTCCTCAGGCGAAGGTAC-
TAGTACTGGTTCTGGTGGAAGTGGAGGTTCAGGTGGAGCA
GACGACATTGTACTGACCCAGTCTCCAGCAACTCTGTCTCT
GTCTCCAGGGGAGCGTGCCACCCTGACCTGCAGAGC-
CAGTTCAAGTGTAAGTTACATGAACTGGTACCAGCA-
GAAGCCGGGCAAGGCACCCAAAAGATGGATTTATGACA-
CATCCAAAGTGGCTTCTGGAGTCCCTGCTCGCTTCAGTGGC
AGTGGGTCTGGGACCGACTACTCTCTCACAATCAA-
CAGCTTGGAGGCTGAAGATGCTGCCACTTATTACTGCCAA-
CAGTGGAGTAGTAACCCGCTCACGTTCGGTGGCGGGAC-
CAAGGTGGAGATCAAA

F) anti-CD3(VH2/VL3)

DVQLVQSGAEVKKPGASVKVSCKASGYTATRYTMHWVR-
QAPGQGLEWIGYINPSRGYTNY-
AQKLQGRVTMTTDTSTSTAYMELSSLRSEDTATYYCA-
RYYDDHYCLDYWGQGTTVTVSSGEGTSTGSGGSGGSGGADD
IVLTQSPATLSLSPGERATLTCRASSSVSYMNWYQQKPG-
KAPKRWIYDTSKVASGVPARFSGSGSGTDYSLTINSLEAE-
DAATYYCQQWSSNPLTFGGGTKVEIK

Figure 4
A) anti-CD3 (VH3/VL1)

GACGTCCAACTGGTGCAGTCAGGGGCTGAAGTGAAAAAACC
TGGGGCCTCAGTGAAGGTGTCCTGCAAGGCTTCTGGCTACA
CCGCTACTAGGTACACGATGCACTGGGTAAGGCAGGCACCT
GGACAGGGTCTGGAATGGATTGGATACATTAATCCTAGCCG
TGGTTATACTAATTACGCACAGAAGTTGCAGGGCCGCGTCA
CAATGACTACAGACACTTCCACCAGCACAGCCTACCTGCAA
ATGAACAGCCTGAAAACTGAGGACACTGCAGTCTATTACTG
TGCAAGATATTATGATGATCATTACTGCCTTGACTACTGGG
GCCAAGGCACCACGGTCACCGTCTCCTCAGGCGAAGGTACT
AGTACTGGTTCTGGTGGAAGTGGAGGTTCAGGTGGAGCAGA
CGACATTCAGATGACCCAGTCTCCATCTAGCCTGTCTGCAT
CTGTCGGGGACCGTGTCACCATCACCTGCAGAGCCAGTCAA
AGTGTAAGTTACATGAACTGGTACCAGCAGAAGCCGGGCAA
GGCACCCAAAAGATGGATTTATGACACATCCAAAGTGGCTT
CTGGAGTCCCTGCTCGCTTCAGTGGCAGTGGGTCTGGGACC
GACTACTCTCACAATCAACAGCTTGGAGGCTGAAGATGC
TGCCACTTATTACTGCCAACAGTGGAGTAGTAACCCGCTCA
CGTTCGGTGGCGGGACCAAGGTGGAGATCAAA

B) anti-CD3 (VH3/VL1)

DVQLVQSGAEVKKPGASVKVSCKASGYTATRYTMHWVR-
QAPGQGLEWIGYINPSRGYTNY-
AQKLQGRVTMTTDTSTSTAYLQMNSLKTEDTAVYYCARYYDD-
HYCLDYWGQGTTVTVSSGEGTSTGSGGSGGSGGADDIQMTQSP
SSLSASVGDRVTITCRASQSVSYMNWYQQKPG-
KAPKRWIYDTSKVASGVPARFSGSGSGTDYSLTINSLEAE-
DAATYYCQQWSSNPLTFGGGTKVEIK

Figure 4
C) anti-CD3(VH3/VL2)

GACGTCCAACTGGTGCAGTCAGGGGCTGAAGTGAAAAAACC
TGGGGCCTCAGTGAAGGTGTCCTGCAAGGCTTCTGGCTACA
CCGCTACTAGGTACACGATGCACTGGGTAAGGCAGGCACCT
GGACAGGGTCTGGAATGGATTGGATACATTAATCCTAGCCG
TGGTTATACTAATTACGCACAGAAGTTGCAGGGCCGCGTCA
CAATGACTACAGACACTTCCACCAGCACAGCCTACCTGCAA
ATGAACAGCCTGAAAACTGAGGACACTGCAGTCTATTACTG
TGCAAGATATTATGATGATCATTACTGCCTTGACTACTGGG
GCCAAGGCACCACGGTCACCGTCTCCTCAGGCGAAGGTACT
AGTACTGGTTCTGGTGGAAGTGGAGGTTCAGGTGGAGCAGA
CGACATTGTACTGACCCAGTCTCCAGCAACTCTGTCTCTGT
CTCCAGGGGAGCGTGCCACCCTGAGCTGCAGAGCCAGTCAA
AGTGTAAGTTACATGAACTGGTACCAGCAGAAGCCGGGCAA
GGCACCCAAAAGATGGATTTATGACACATCCAAAGTGGCTT
CTGGAGTCCCTGCTCGCTTCAGTGGCAGTGGGTCTGGGACC
GACTACTCTCTCACAATCAACAGCTTGGAGGCTGAAGATGC
TGCCACTTATTACTGCCAACAGTGGAGTAGTAACCCGCTCA
CGTTCGGTGGCGGGACCAAGGTGGAGATCAAA

D) anti-CD3(VH3/VL2)
DVQLVQSGAEVKKPGASVKVSCKASGYTATRYTMHWVRQAP
GQGLEWIGYINPSRGYTNYAQKLQGRVTMTTDTSTSTAYLQ
MNSLKTEDTAVYYCARYYDDHYCLDYWGQGTTVTVSSGEGT
STGSGGSGGSGGADDIVLTQSPATLSLSPGERATLSCRASQ
SVSYMNWYQQKPGKAPKRWIYDTSKVASGVPARFSGSGSGT
DYSLTINSLEAEDAATYYCQQWSSNPLTFGGGTKVEIK

Figure 4

E) anti-CD3 (VH3/VL3)

GACGTCCAACTGGTGCAGTCAGGGGCTGAAGTGAAAA-
AACCTGGGGCCTCAGTGAAGGTGTCCTG-
CAAGGCTTCTGGCTACACCGCTACTAGGTACACGATG-
CACTGGGTAAGGCAGGCACCTGGACAGGGTCTGGAATGGAT
TGGATACATTAATCCTAGCCGTGGTTATACTAATTACGCA-
CAGAAGTTGCAGGGCCGCGTCACAATGACTACAGA-
CACTTCCACCAGCACAGCCTACCTGCAAATGAACAGCCT-
GAAAACTGAGGACACTGCAGTCTATTACTGTGCAAGATATT
ATGATGATCATTACTGCCTTGACTACTGGGGCCAAGGCAC-
CACGGTCACCGTCTCCTCAGGCGAAGGTACTAG-
TACTGGTTCTGGTGGAAGTGGAGGTTCAGGTGGAGCAGAC-
GACATTGTACTGACCCAGTCTCCAGCAACTCTGTCTCTGTC
TCCAGGGGAGCGTGCCACCCTGACCTGCAGAGCCAGTT-
CAAGTGTAAGTTACATGAACTGGTACCAGCAGAAGCCGGG-
CAAGGCACCCAAAAGATGGATTTATGACACATCCA-
AAGTGGCTTCTGGAGTCCCTGCTCGCTTCAGTGGCAGTGGG
TCTGGGACCGACTACTCTCTCACAATCAACAGCTTG-
GAGGCTGAAGATGCTGCCACTTATTACTGCCAACAGTG-
GAGTAGTAACCCGCTCACGTTCGGTGGCGGGACCAAGGTG-
GAGATCAAA

F) anti-CD3 (VH3/VL3)

DVQLVQSGAEVKKPGASVKVSCKASGYTATRYTMHWVR-
QAPGQGLEWIGYINPSRGYTNY-
AQKLQGRVTMTTDTSTSTAYLQMNSLKTEDTAVYYCA-
RYYDDHYCLDYWGQGTTVTVSSGEGTSTGSGGSGGSGGADD
IVLTQSPATLSLSPGERATLTCRASSSVSYMNWYQQKPG-
KAPKRWIYDTSKVASGVPARFSGSGSGTDYSLTINSLEAE-
DAATYYCQQWSSNPLTFGGGTKVEIK

Figure 5

A) CD3 (VH5/VL1)

GACGTCCAACTGGTGCAGTCAGGGGCTGAAGTGAAAAAACC
TGGGGCCTCAGTGAAGGTGTCCTGCAAGGCTTCTGGCTACA
CCTTTACTAGGTACACGATGCACTGGGTAAGGCAGGCACCT
GGACAGGGTCTGGAATGGATTGGATACATTAATCCTAGCCG
TGGTTATACTAATTACGCAGACAGCGTCAAGGGCCGCTTCA
CAATCACTACAGACAAATCCACCAGCACAGCCTACATGGAA
CTGAGCAGCCTGCGTTCTGAGGACACTGCAACCTATTACTG
TGCAAGATATTATGATGATCATTACTGCCTTGACTACTGGG
GCCAAGGCACCACGGTCACCGTCTCCTCAGGCGAAGGTACT
AGTACTGGTTCTGGTGGAAGTGGAGGTTCAGGTGGAGCAGA
CGACATTCAGATGACCCAGTCTCCATCTAGCCTGTCTGCAT
CTGTCGGGGACCGTGTCACCATCACCTGCAGAGCCAGTCAA
AGTGTAAGTTACATGAACTGGTACCAGCAGAAGCCGGGCAA
GGCACCCAAAAGATGGATTTATGACACATCCAAAGTGGCTT
CTGGAGTCCCTGCTCGCTTCAGTGGCAGTGGGTCTGGGACC
GACTACTCTCTCACAATCAACAGCTTGGAGGCTGAAGATGC
TGCCACTTATTACTGCCAACAGTGGAGTAGTAACCCGCTCA
CGTTCGGTGGCGGGACCAAGGTGGAGATCAAA

B) CD3 (VH5/VL1)

DVQLVQSGAEVKKPGASVKVSCKASGYTFTRYTMHWVRQAP
GQGLEWIGYINPSRGYTNYADSVKGRFTITTDKSTSTAYME
LSSLRSEDTATYYCARYYDDHYCLDYWGQGTTVTVSSGEGT
STGSGGSGGSGGADDIQMTQSPSSLSASVGDRVTITCRASQ
SVSYMNWYQQKPGKAPKRWIYDTSKVASGVPARFSGSGSGT
DYSLTINSLEAEDAATYYCQQWSSNPLTFGGGTKVEIK

Figure 5

C) anti-CD3(VH5/VL2)

GACGTCCAACTGGTGCAGTCAGGGGCTGAAGTGAAAAAACC
TGGGGCCTCAGTGAAGGTGTCCTGCAAGGCTTCTGGCTACA
CCTTTACTAGGTACACGATGCACTGGGTAAGGCAGGCACCT
GGACAGGGTCTGGAATGGATTGGATACATTAATCCTAGCCG
TGGTTATACTAATTACGCAGACAGCGTCAAGGGCCGCTTCA
CAATCACTACAGACAAATCCACCAGCACAGCCTACATGGAA
CTGAGCAGCCTGCGTTCTGAGGACACTGCAACCTATTACTG
TGCAAGATATTATGATGATCATTACTGCCTTGACTACTGGG
GCCAAGGCACCACGGTCACCGTCTCCTCAGGCGAAGGTACT
AGTACTGGTTCTGGTGGAAGTGGAGGTTCAGGTGGAGCAGA
CGACATTGTACTGACCCAGTCTCCAGCAACTCTGTCTCTGT
CTCCAGGGGAGCGTGCCACCCTGAGCTGCAGAGCCAGTCAA
AGTGTAAGTTACATGAACTGGTACCAGCAGAAGCCGGGCAA
GGCACCCAAAAGATGGATTTATGACACATCCAAAGTGGCTT
CTGGAGTCCCTGCTCGCTTCAGTGGCAGTGGGTCTGGGACC
GACTACTCTCTCACAATCAACAGCTTGGAGGCTGAAGATGC
TGCCACTTATTACTGCCAACAGTGGAGTAGTAACCCGCTCA
CGTTCGGTGGCGGGACCAAGGTGGAGATCAAA

D) anti-CD3(VH5/VL2)

DVQLVQSGAEVKKPGASVKVSCKASGYTFTRYTMHWVRQAP
GQGLEWIGYINPSRGYTNYADSVKGRFTITTDKSTSTAYME
LSSLRSEDTATYYCARYYDDHYCLDYWGQGTTVTVSSGEGT
STGSGGSGGSGGADDIVLTQSPATLSLSPGERATLSCRASQ
SVSYMNWYQQKPGKAPKRWIYDTSKVASGVPARFSGSGSGT
DYSLTINSLEAEDAATYYCQQWSSNPLTFGGGTKVEIK

Figure 5

E) anti-CD3(VH5/VL3)

GACGTCCAACTGGTGCAGTCAGGGGCTGAAGTGAAAA-
AACCTGGGGCCTCAGTGAAGGTGTCCTG-
CAAGGCTTCTGGCTACACCTTTACTAGGTACACGATG-
CACTGGGTAAGGCAGGCACCTGGACAGGGTCTGGAATGGAT
TGGATACATTAATCCTAGCCGTGGTTATACTAATTACG-
CAGACAGCGTCAAGGGCCGCTTCACAATCACTACAGACA-
AATCCACCAGCACAGCCTACATGGAACTGAG-
CAGCCTGCGTTCTGAGGACACTGCAACCTATTACTGTGCAA
GATATTATGATGATCATTACTGCCTTGACTACTGGGGC-
CAAGGCACCACGGTCACCGTCTCCTCAGGCGAAGGTAC-
TAGTACTGGTTCTGGTGGAAGTGGAGGTTCAGGTGGAG-
CAGACGACATTGTACTGACCCAGTCTCCAGCAACTCTGTCT
CTGTCTCCAGGGGAGCGTGCCACCCTGACCTGCAGAGC-
CAGTTCAAGTGTAAGTTACATGAACTGGTACCAGCA-
GAAGCCGGGCAAGGCACCCAAAAGATGGATTTATGACA-
CATCCAAAGTGGCTTCTGGAGTCCCTGCTCGCTTCAGTGGC
AGTGGGTCTGGGACCGACTACTCTCTCACAATCAA-
CAGCTTGGAGGCTGAAGATGCTGCCACTTATTACTGC-
CAACAGTGGAGTAGTAACCCGCTCACGTTCGGTGGCGG-
GACCAAGGTGGAGATCAAA

F) anti-CD3(VH5/VL3)

DVQLVQSGAEVKKPGASVKVSCKASGYTFTRYTMHWVR-
QAPGQGLEWIGYINPSRGYTNY-
ADSVKGRFTITTDKSTSTAYMELSSLRSEDTATYYCA-
RYYDDHYCLDYWGQGTTVTVSSGEGTSTGSGGSGGSGGADD
IVLTQSPATLSLSPGERATLTCRASSSVSYMNWYQQKPG-
KAPKRWIYDTSKVASGVPARFSGSGSGTDYSLTINSLEAE-
DAATYYCQQWSSNPLTFGGGTKVEIK

Figure 6

A) anti-CD3(VH7/VL1)

GACGTCCAACTGGTGCAGTCAGGGGCTGAAGTGAAAAAACC
TGGGGCCTCAGTGAAGGTGTCCTGCAAGGCTTCTGGCTACA
CCTTTACTAGGTACACGATGCACTGGGTAAGGCAGGCACCT
GGACAGGGTCTGGAATGGATTGGATACATTAATCCTAGCCG
TGGTTATACTAATTACAATCAGAAGTTCAAGGACCGCGTCA
CAATCACTACAGACAAATCCACCAGCACAGCCTACATGGAA
CTGAGCAGCCTGCGTTCTGAGGACACTGCAGTCTATTACTG
TGCAAGATATTATGATGATCATTACTGCCTTGACTACTGGG
GCCAAGGCACCACGGTCACCGTCTCCTCAGGCGAAGGTACT
AGTACTGGTTCTGGTGGAAGTGGAGGTTCAGGTGGAGCAGA
CGACATTCAGATGACCCAGTCTCCATCTAGCCTGTCTGCAT
CTGTCGGGGACCGTGTCACCATCACCTGCAGAGCCAGTCAA
AGTGTAAGTTACATGAACTGGTACCAGCAGAAGCCGGGCAA
GGCACCCAAAAGATGGATTTATGACACATCCAAAGTGGCTT
CTGGAGTCCCTGCTCGCTTCAGTGGCAGTGGGTCTGGGACC
GACTACTCTCTCACAATCAACAGCTTGGAGGCTGAAGATGC
TGCCACTTATTACTGCCAACAGTGGAGTAGTAACCCGCTCA
CGTTCGGTGGCGGGACCAAGGTGGAGATCAAA

B) anti-CD3(VH7/VL1)

DVQLVQSGAEVKKPGASVKVSCKASGYTFTRYTMHWVR-
QAPGQGLEWIGYINPSRGYT-
NYNQKFKDRVTITTDKSTSTAYMELSSLRSEDTAVYYCA-
RYYDDHYCLDYWGQGTTVTVSSGEGTSTGSGGSGGSGGADD
IQMTQSPSSLSASVGDRVTITCRASQSVSYMNWYQQKPG-
KAPKRWIYDTSKVASGVPARFSGSGSGTDYSLTINSLEAE-
DAATYYCQQWSSNPLTFGGGTKVEIK

Figure 6
C) anti-CD3(VH7/VL2)

GACGTCCAACTGGTGCAGTCAGGGGCTGAAGTGAAAAAACC
TGGGGCCTCAGTGAAGGTGTCCTGCAAGGCTTCTGGCTACA
CCTTTACTAGGTACACGATGCACTGGGTAAGGCAGGCACCT
GGACAGGGTCTGGAATGGATTGGATACATTAATCCTAGCCG
TGGTTATACTAATTACAATCAGAAGTTCAAGGACCGCGTCA
CAATCACTACAGACAAATCCACCAGCACAGCCTACATGGAA
CTGAGCAGCCTGCGTTCTGAGGACACTGCAGTCTATTACTG
TGCAAGATATTATGATGATCATTACTGCCTTGACTACTGGG
GCCAAGGCACCACGGTCACCGTCTCCTCAGGCGAAGGTACT
AGTACTGGTTCTGGTGGAAGTGGAGGTTCAGGTGGAGCAGA
CGACATTGTACTGACCCAGTCTCCAGCAACTCTGTCTCTGT
CTCCAGGGGAGCGTGCCACCCTGAGCTGCAGAGCCAGTCAA
AGTGTAAGTTACATGAACTGGTACCAGCAGAAGCCGGGCAA
GGCACCCAAAAGATGGATTTATGACACATCCAAAGTGGCTT
CTGGAGTCCCTGCTCGCTTCAGTGGCAGTGGGTCTGGGACC
GACTACTCTCTCACAATCAACAGCTTGGAGGCTGAAGATGC
TGCCACTTATTACTGCCAACAGTGGAGTAGTAACCCGCTCA
CGTTCGGTGGCGGGACCAAGGTGGAGATCAAA

D) anti-CD3(VH7/VL2)

DVQLVQSGAEVKKPGASVKVSCKASGYTFTRYTMHWVR-
QAPGQGLEWIGYINPSRGYT-
NYNQKFKDRVTITTDKSTSTAYMELSSLRSEDTAVYYCA-
RYYDDHYCLDYWGQGTTVTVSSGEGTSTGSGGSGGSGGADD
IVLTQSPATLSLSPGERATLSCRASQSVSYMNWYQQKPG-
KAPKRWIYDTSKVASGVPARFSGSGSGTDYSLTINSLEAE-
DAATYYCQQWSSNPLTFGGGTKVEIK

Figure 6

E) anti-CD3(VH7/VL3)

GACGTCCAACTGGTGCAGTCAGGGGCTGAAGTGAAAA-
AACCTGGGGCCTCAGTGAAGGTGTCCTG-
CAAGGCTTCTGGCTACACCTTTACTAGGTACACGATG-
CACTGGGTAAGGCAGGCACCTGGACAGGGTCTGGAATGGAT
TGGATACATTAATCCTAGCCGTGGTTATACTAATTACAAT-
CAGAAGTTCAAGGACCGCGTCACAATCACTACAGACA-
AATCCACCAGCACAGCCTACATGGAACTGAG-
CAGCCTGCGTTCTGAGGACACTGCAGTCTATTACTGTGCAA
GATATTATGATGATCATTACTGCCTTGACTACTGGGGC-
CAAGGCACCACGGTCACCGTCTCCTCAGGCGAAGGTAC-
TAGTACTGGTTCTGGTGGAAGTGGAGGTTCAGGTGGAGCA-
GACGACATTGTACTGACCCAGTCTCCAGCAACTCTGTCTCT
GTCTCCAGGGGAGCGTGCCACCCTGACCTGCAGAGC-
CAGTTCAAGTGTAAGTTACATGAACTGGTACCAGCA-
GAAGCCGGGCAAGGCACCCAAAAGATGGATTTATGACA-
CATCCAAAGTGGCTTCTGGAGTCCCTGCTCGCTTCAGTGGC
AGTGGGTCTGGGACCGACTACTCTCTCACAATCAA-
CAGCTTGGAGGCTGAAGATGCTGCCACTTATTACTGCCAA-
CAGTGGAGTAGTAACCCGCTCACGTTCGGTGGCGGGAC-
CAAGGTGGAGATCAAA

F) anti-CD3(VH7/VL3)

DVQLVQSGAEVKKPGASVKVSCKASGYTFTRYTMHWVR-
QAPGQGLEWIGYINPSRGYT-
NYNQKFKDRVTITTDKSTSTAYMELSSLRSEDTAVYYCA-
RYYDDHYCLDYWGQGTTVTVSSGEGTSTGSGGSGGSGGADD
IVLTQSPATLSLSPGERATLTCRASSSVSYMNWYQQKPG-
KAPKRWIYDTSKVASGVPARFSGSGSGTDYSLTINSLEAE-
DAATYYCQQWSSNPLTFGGGTKVEIK

Figure 11
A)
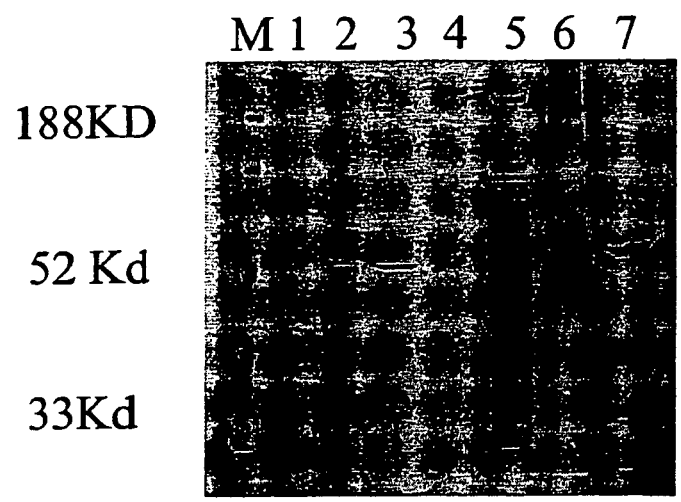
B)
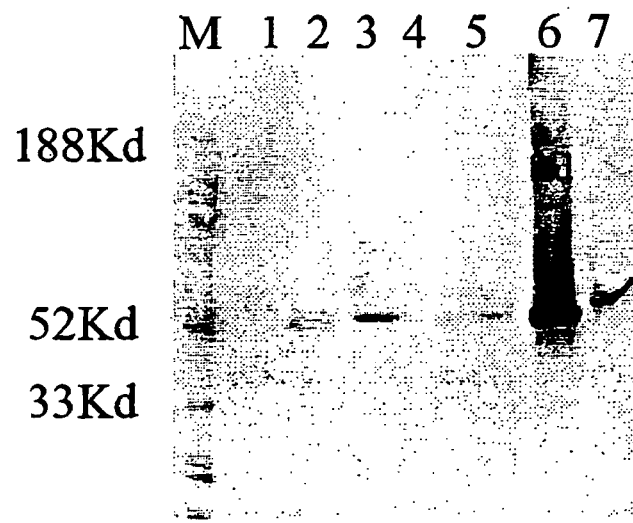

Figure 14

| | FR1 | CDR1 | FR2 | CDR2 |
|---|---|---|---|---|
| nondeimmunized | | | | |
| anti-CD3 | DIKLQQSGAELARPGASVKMSCKTSGYTFTRYTMHWVKQRPGQGLEWIGYINPSRGYTNYNQKFKD |
| anti-CD3 VH5 | DVQLVQSGAEVKKPGASVKVSCKASGYTFTRYTMHWVRQAPGQGLEWIGYINPSRGYTNYNQKFKD |
| anti-CD3 VH7 | DVQLVQSGAEVKKPGASVKVSCKASGYTFTRYTMHWVRQAPGQGLEWIGYINPSRGYTNYADSVKG |
| anti-CD3 VH2 | DVQLVQSGAEVKKPGASVKVSCKASGYTATRYTMHWVRQAPGQGLEWIGYINPSRGYTNYNQKFKD |
| anti-CD3 VH3 | DVQLVQSGAEVKKPGASVKVSCKASGYTATRYTMHWVRQAPGQGLEWIGYINPSRGYTNYAQKLQG |

| | FR3 | CDR3 | FR4 |
|---|---|---|---|
| nondeimmunized | | | |
| anti-CD3 | KATLTTDKSSSTAYMQLSSLTSEDSAVYYCARYYDDHYCLDYWGQGTTLTVSS |
| anti-CD3 VH5 | RFTITTDKSTSTAYMELSSLRSEDTATYYCARYYDDHYCLDYWGQGTTVTVSS |
| anti-CD3 VH7 | RVTITTDKSTSTAYMELSSLRSEDTAVYYCARYYDDHYCLDYWGQGTTVTVSS |
| anti-CD3 VH2 | RVTMTTDTSTSTAYMELSSLRSEDTATYYCARYYDDHYCLDYWGQGTTVTVSS |
| anti-CD3 VH3 | RVTMTTDTSTSTAYLQMNSLKTEDTAVYYCARYYDDHYCLDYWGQGTTVTVSS |

Figure 15 A
antiCD3(VH5/VL2) x 5-10 (SEQ ID NO: 37)
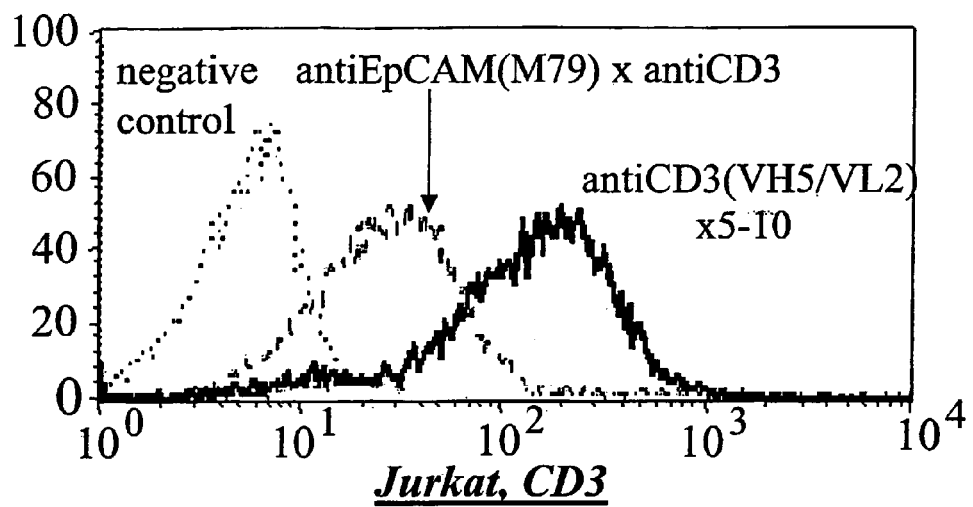
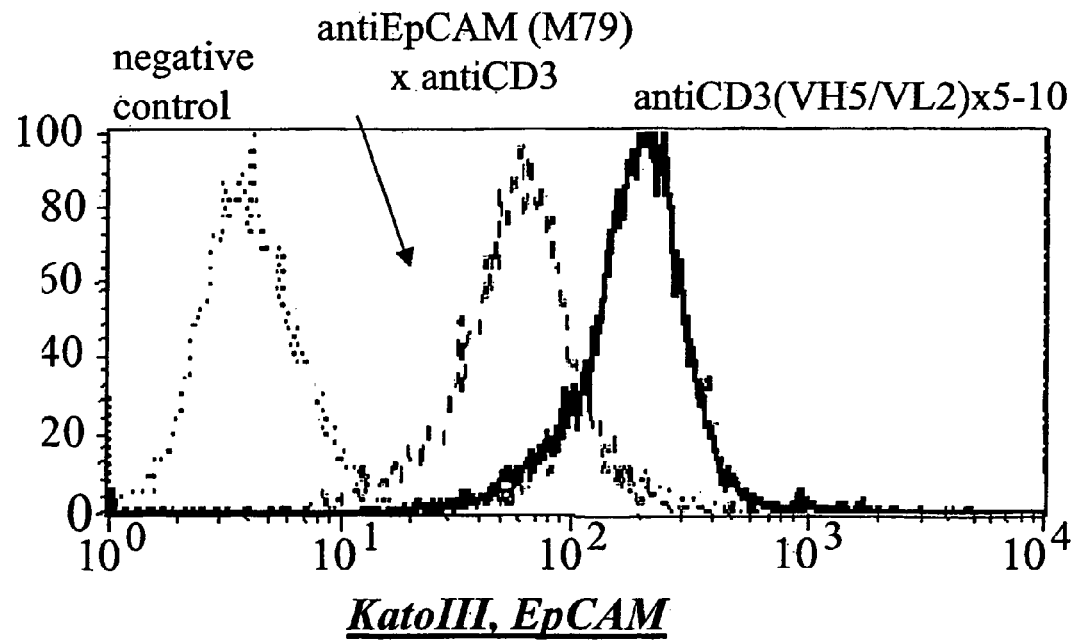

Figure 15B
antiCD3(VH5/VL2) x 4-7 (SEQ ID NO:33)
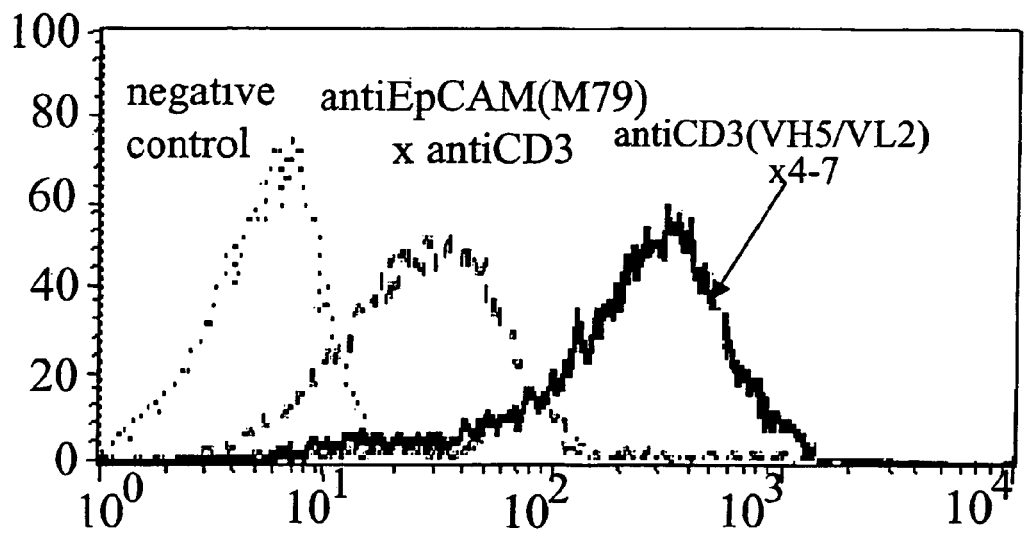
*Jurkat, CD3*
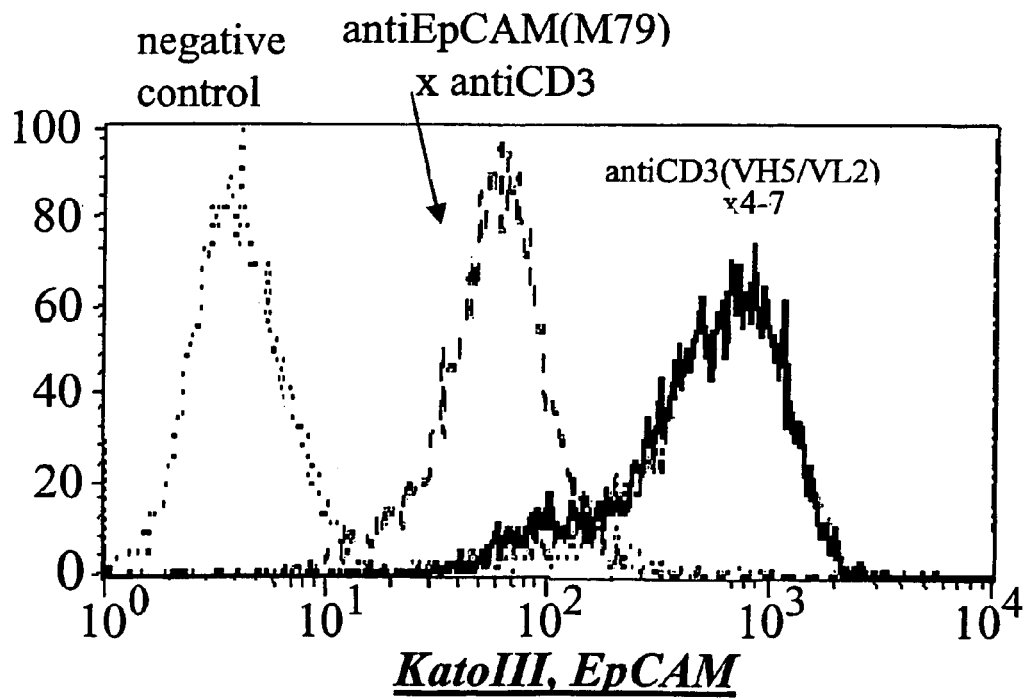
*KatoIII, EpCAM*

Figure 15C
anti CD3(VH5/VL2) x 3-1 (SEQ ID NO:31)
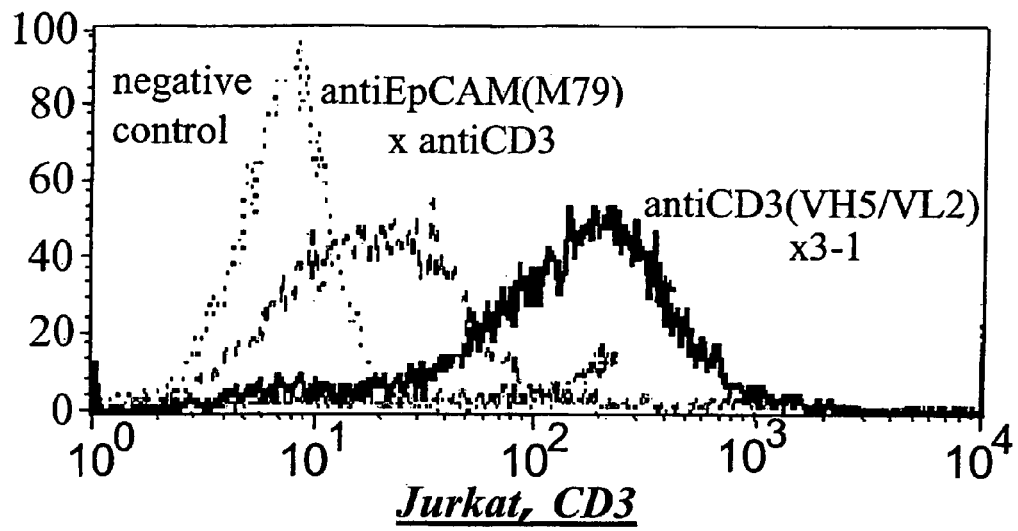
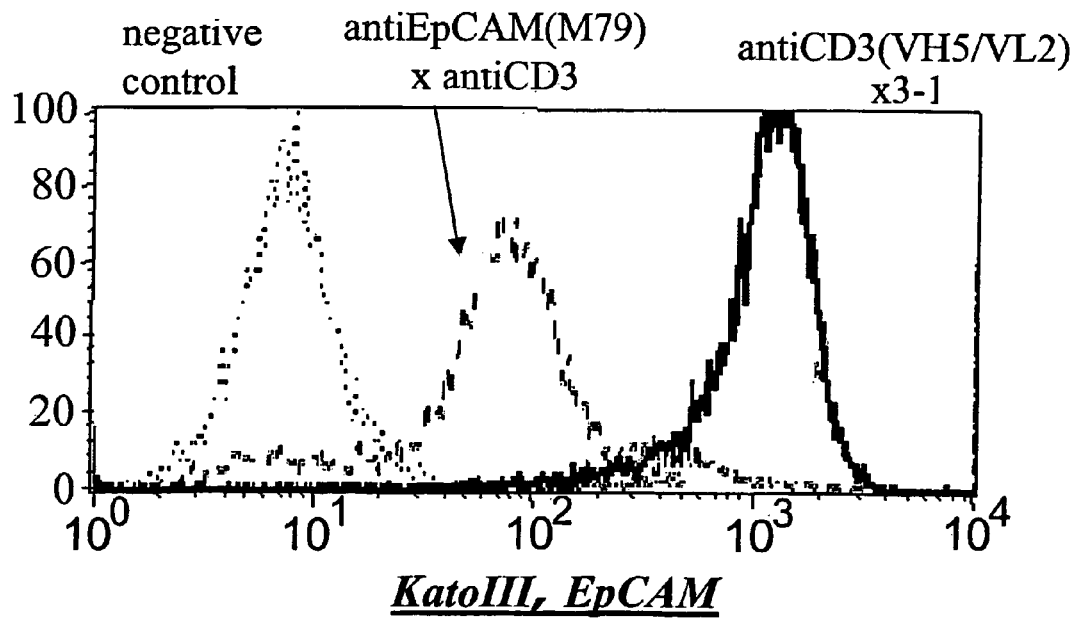

Figure 15 D
antiCD3(VH5/VL2) x 4-7 VL-VH
(SEQ ID NO: 35)
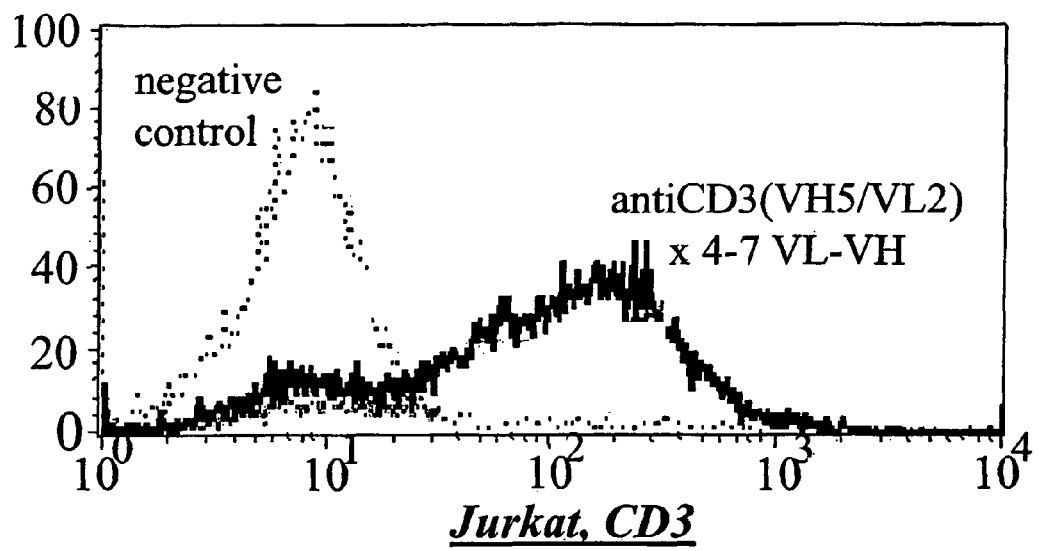
*Jurkat, CD3*
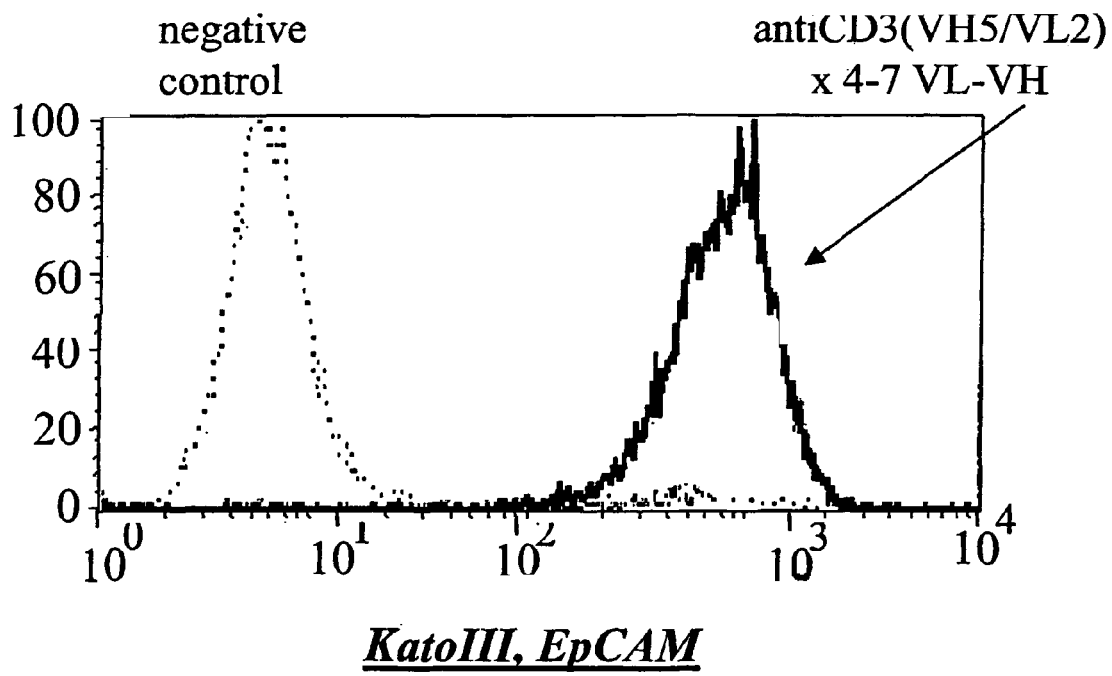
*KatoIII, EpCAM*

Figure 15 E
antiCD3(VH5/VL2) x 5-10 VL-VH
(SEQ ID NO:39)
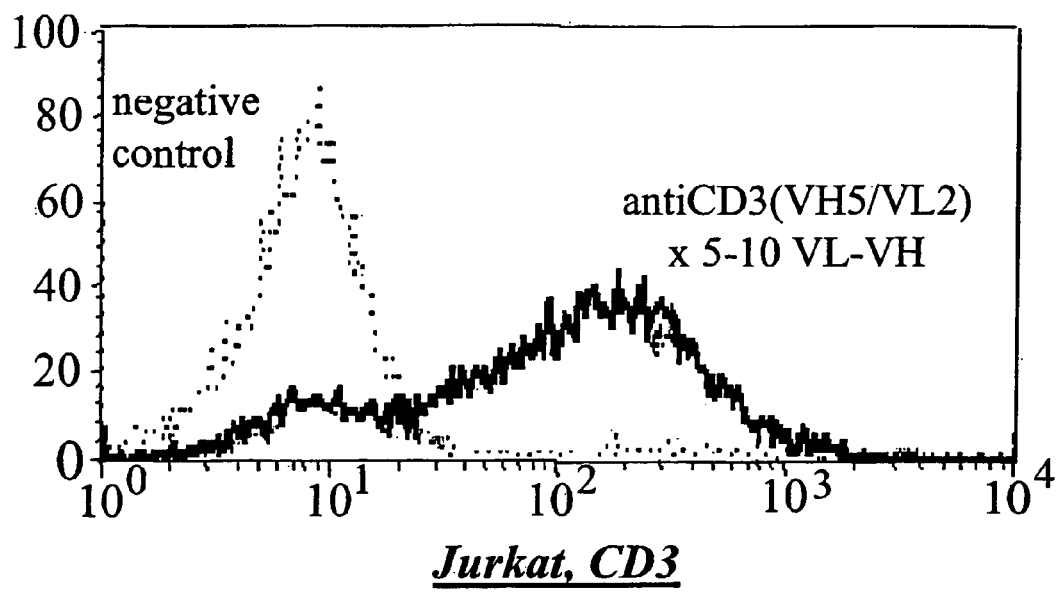
*Jurkat, CD3*
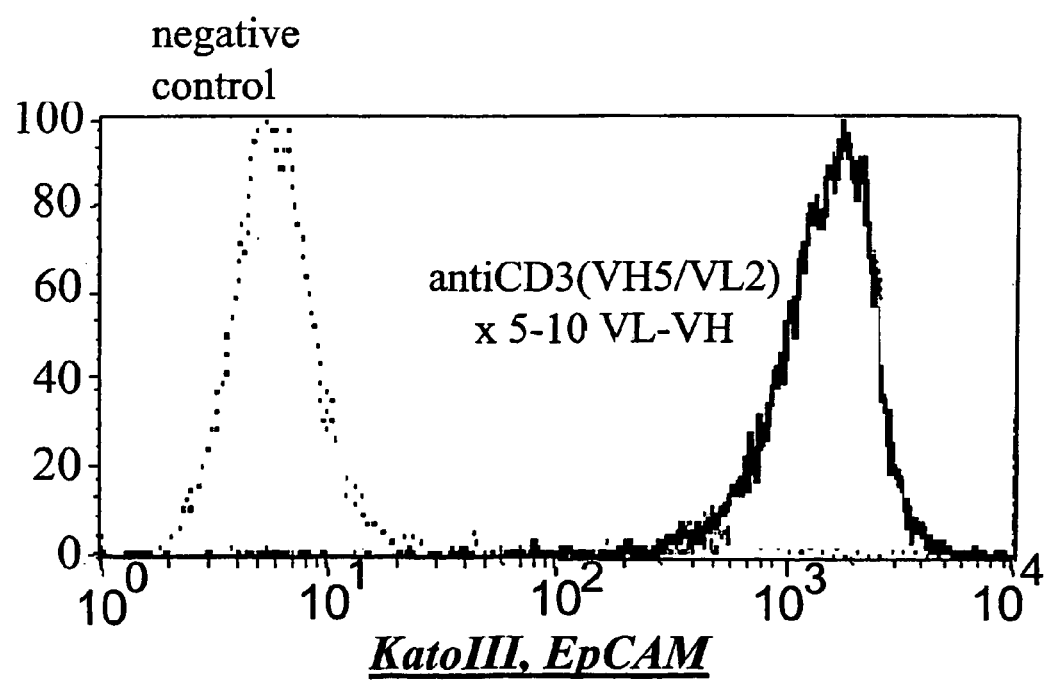
*KatoIII, EpCAM*

Figure 16:
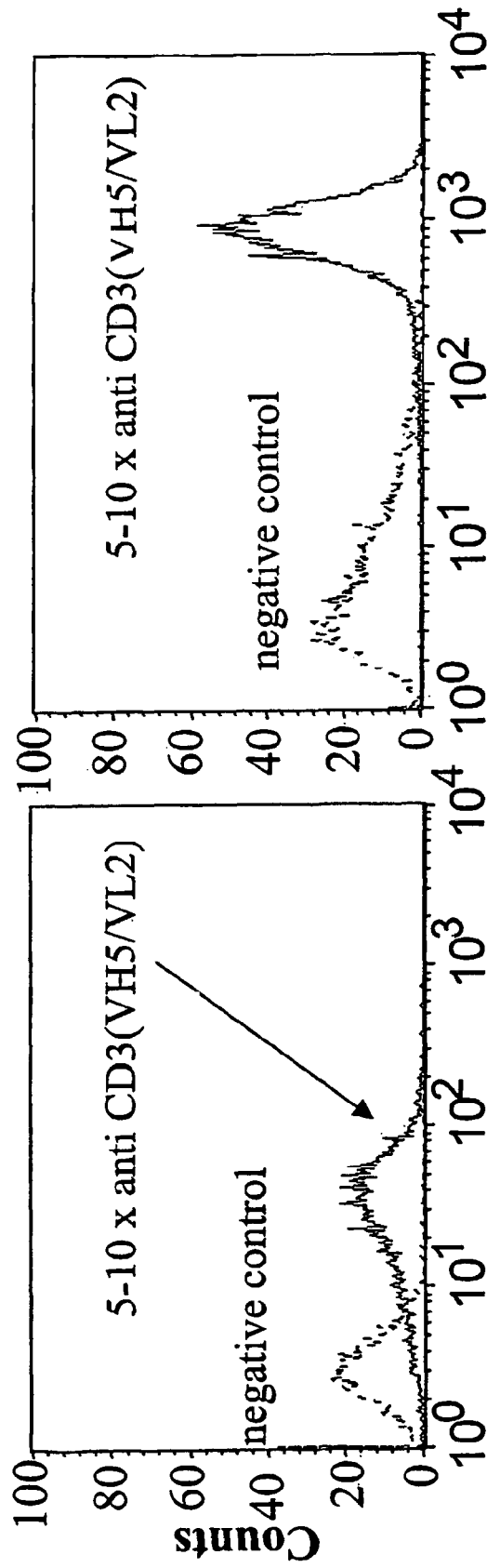

Figure 16 A
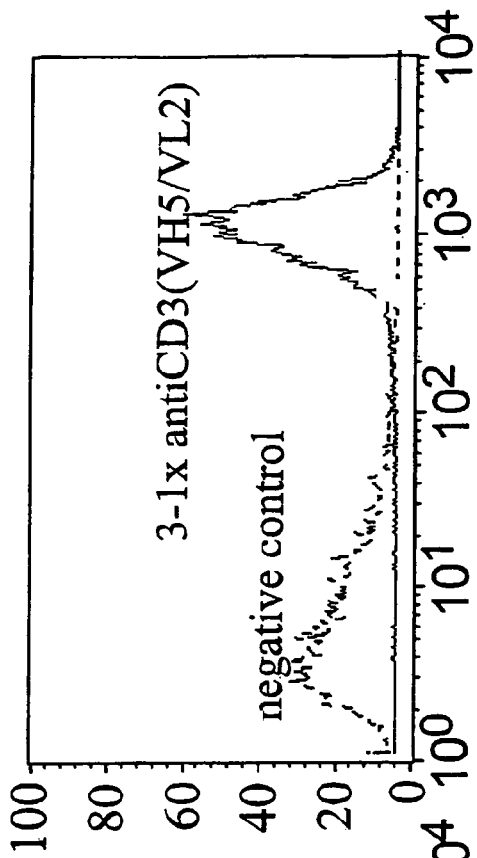
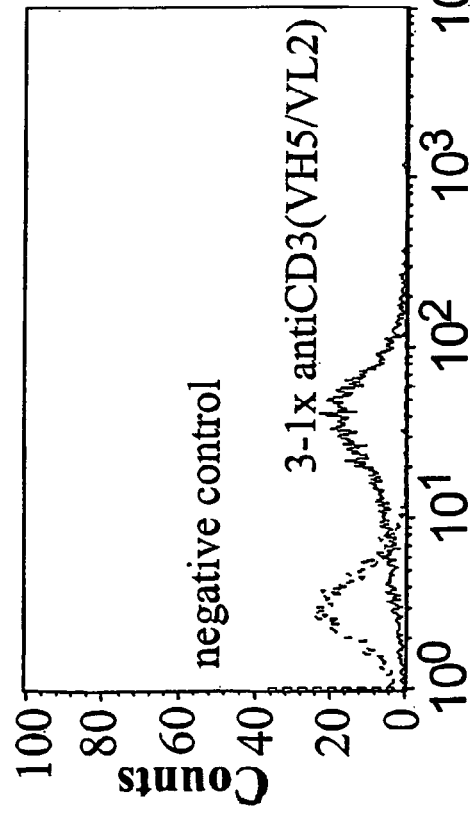

MULTISPECFIC DEIMMUNIZED CD3-BINDERS

The present application is a national stage filing under 35 U.S.C. §371 of PCT Application No.: PCT/US2004/011646, filed on Oct. 15, 2004, which claims priority to EP 03023581.6 filed on Oct. 16, 2003; and all of the disclosures of which are incorporated herein by reference in their entirety.

SEQUENCE LISTING

The instant application contains a "lengthy" Sequence Listing which has been submitted via CD-R in lieu of a printed paper copy, and is hereby incorporated by reference in its entirety. Said CD-R, recorded on Dec. 4, 2006, are labeled CRF, "Copy 1" and "Copy 2", respectively, and each contains only one identical 892 KB file (28622148.APP).

The present invention relates to a cytotoxically active CD3 specific binding construct comprising a first domain specifically binding to human CD3 and an Ig-derived second binding domain. Furthermore, a nucleic acid sequence encoding a CD3 specific binding construct of the invention is provided. Further aspects of the invention are vectors and host cells comprising said nucleic acid sequence, a process for the production of the construct of the invention and composition comprising said construct. The invention also provides the use of said constructs for the preparation of pharmaceutical compositions for the treatment of particular diseases, a method for the treatment of particular diseases and a kit comprising the binding construct of the invention.

Human CD3 denotes an antigen which is expressed on T cells as part of the multimolecular T cell complex and which consists of three different chains: CD3-$\epsilon$, CD3-$\delta$ and CD3-$\gamma$. Clustering of CD3 on T cells, e.g. by immobilized anti-CD3 antibodies leads to T cell activation similar to the engagement of the T cell receptor but independent of its clone-typical specificity; see WO 99/54440 or Hoffman (1985) J. Immunol. 135:5-8.

Antibodies which specifically recognize CD3 antigen are described in the prior art, e.g. in Traunecker, EMBO J 10 (1991), 3655-9 and Kipriyanov, Int. J. Cancer 77 (1998), 763-772. Lately, antibodies directed against CD3 have been proposed in the treatment of a variety of diseases. These antibodies or antibody constructs act as either T-cell depleting agents or as mitogenic agents, as disclosed in EP 1 025 854. Human/rodent hybrid antibodies which specifically bind to the human CD3 antigen complex are disclosed in WO 00/05268 and are proposed as immunosuppressive agents, for example for the treatment of rejection episodes following the transplantation of the renal, septic and cardiac allografts. WO 03/04648 discloses a bispecific antibody directed to CD3 and to an ovarian cancer antigen. Furthermore, Kufer (1997) Cancer Immunol Immunother 45:193-7 relates to a bispecific antibody specific for CD3 and EpCAM for the therapy of minimal residual cancer.

However, prior art antibodies directed against CD3 are derived from non-human sources. This leads to several serious problems when using such anti-CD3 antibodies as part of a therapeutic regimen in humans.

One such problem is "cytokine release syndrome (CRS)". CRS is a clinical syndrome which has been observed following the administration of the first few doses of anti-CD3 antibodies and is related to the fact that many antibodies directed against CD3 are mitogenic. In vitro, mitogenic antibodies directed against CD3 induce T cell proliferation and cytokine production. In vivo this mitogenic activity leads to the large-scale release of cytokines, including many T cell-derived cytokines, within the initial hours after the first injection of antibody. The mitogenic capacity of CD3-specific antibodies is monocyte/macrophage dependent and it involves the production of IL-6 and IL-1$\beta$ by these cells.

CRS symptoms range from frequently reported mild "flu-like" symptoms to less frequently reported severe "shock-like" reactions (which may include cardiovascular and central nervous system manifestations). Symptoms include, inter alia, headache, tremor, nausea/vomiting, diarrhoea, abdominal pain, malaise and muscle/joint aches and pains, generalized weakness, cardiorespiratory events as well as neuropsychiatric events. Severe pulmonary oedema has occurred in patients with fluid overload and in those who appeared not to have a fluid overload. Another serious problem hampering the therapeutic use of, especially, murine monoclonal antibodies is the mounting of a humoral immune response against such antibodies, resulting in the production of human anti-mouse antibodies ("HAMAs") (Schroff (1985) Cancer Res. 45:879-885, Shawler (1985) J. Immunol. 135:1530-1535). HAMAs are typically generated during the second week of treatment with the murine antibody and neutralize the murine antibodies, thereby blocking their ability to bind to their intended target. The HAMA response can depend on the murine constant ("Fc") antibody regions or/and the nature of the murine variable ("V") regions.

The prior art contains various approaches to reducing or preventing the production of HAMAs by modifying monoclonal antibodies of non-human origin.

One approach to reducing the immunogenicity of such antibodies is by humanization, as for example described in WO 91/09968 and U.S. Pat. No. 6,407,213. In general, humanization entails substitutions of non-human antibody sequences for corresponding human sequences, as for example is the case with CDR-grafting.

Another approach to reducing the immunogenicity of such antibodies is by deimmunization, as for example described in WO 00/34317, WO 98/52976, WO 02/079415, WO 02/012899 and WO 02/069232. In general, deimmunization entails carrying out substitutions of amino acids within potential T cell epitopes. In this way, the likelihood that a given sequence will give rise to T cell epitopes upon intracellular protein processing is reduced. Moreover, WO 92/10755 describes an approach in which antigenic determinants on proteins are engineered. Particularly, proteins are epitope mapped and their amino acid sequence is changed through genetic engineering.

However, humanized antibodies often exhibit a decreased binding affinity with respect to their target as compared to their non-humanized parent antibodies and also often are still somewhat immunogenic in a human host.

Therefore, the technical problem of the present invention was the provision of means and methods for the treatment of and/or the amelioration of tumorous diseases, proliferative disorders as well as B-cell related diseases by induction of T cell mediated immune response. The above-mentioned means and methods should overcome the recited disadvantages of known antibody-based therapies.

The solution to said technical problem is achieved by providing the embodiments characterized in the claims.

Accordingly, the present invention relates to a cytotoxically active CD3 specific binding construct comprising a first domain specifically binding to human CD3 and an Ig-derived second binding domain,
wherein said first domain is deimmunized and comprises a CDR-H1 region, a CDR-H2 region and a CDR-H3 region, said CDR-H3 region comprising an amino acid sequence as depicted in SEQ ID NO.: 96, 108, 119, 120, 121, 122, 123, 124, 125, 126, or 127; and wherein said first domain further comprises in its framework H1 the sequence VKK (Val-Lys-Lys) and wherein the transition sequence between framework H1 and CDR-H1 region comprises the sequence Ala-Ser-Gly-Tyr-Thr-Phe (AS-GYTF; SEQ ID NO.: 233).

It was surprisingly found that the above-recited, specific modifications to known CDR regions as well as framework regions and their corresponding transition sequences lead to deimmunized, CD3 specific binding molecules which show reduced immunogenicity but retain their cytotoxic activity compared to original non-deimmunized sequences. This finding was in particular surprising since not all possible deimmunization protocols led to bioactive, functional constructs which show distinct cytotoxic activity; see appended examples. Furthermore, surprisingly the deimmunized cytotoxically active CD3 binding molecules showed increased productivity. In accordance with this invention, specific sequences of non-deimmunized antibodies have been replaced by/modified to the sequences recited herein above. In particular, in framework H1 regions the original sequence Leu-Ala-Arg (LAR) has been replaced by the sequence Val-Lys-Lys (VKK). Furthermore, the sequence Thr-Ser-Gly-Tyr-Thr-Phe (TSGYTF) (SEQ ID NO: 410) comprised in the transition region of framework H1 and CDR-H1 of some non-modified/non-deimmunized CD3 specific antibodies has been modified in accordance with the invention to Ala-Ser-Gly-Tyr-Thr-Phe (ASGYTF) (SEQ ID NO.:233) (see FIG. 14). A desired, inventive CD3-specific binding construct is characterized as comprising at least two binding specificities whereby a second binding specificity is Ig-derived. Furthermore, said desired constructs are characterized by the specific amino acid sequences shown herein above. As documented in the appended examples the constructs as provided herein still retain bioactivity in their modified/deimmunized form. The examples also document that not all deimmunizations, determined by methods known in the art (WO 92/10755, WO 00/34317, WO 98/52976, WO 02/079415 or WO 02/012899), lead to bioactive molecules; see in particular the examples 2 and 5.

The term "cytotoxically active CD3 binding construct" as used herein relates to a CD3 specific construct capable of binding to human CD3 complex expressed on T cells and capable of inducing elimination/lysis of target cells. Binding of CD3 specific binders of the CD3/CD3 complex (e.g. antibodies, antibody derivatives or antibody fragments) leads to activation of T cells as known in the art; see WO 99/54440. Accordingly, an inventive construct has to be able to eliminate/lyse target cells in vivo and/or in vitro. Corresponding target cells comprise cells expressing a surface molecule, which is recognized by the second Ig-derived binding domain of the inventive constructs. Such surface molecules are characterized herein below. Cytotoxicity can be detected by methods known in the art and methods as illustrated herein below and in the appended examples. Accordingly, such methods comprise, inter alia, physiological in vitro assays. Such physiological assays may monitor cell death, for example by loss of cell membrane integrity (e.g. FACS based propidium Iodide assay, trypan Blue influx assay, photometric enzyme release assays (LDH), radiometric $^{51}$Cr release assay, fluorometric Europium release and CalceinAM release assays). Further assays comprise monitoring of cell viability, for example by photometric MTT, XTT, WST-1 and alamarBlue assays, radiometric $^{3}$H-Thd incorporation assay, clonogenic assay measuring cell division activity, and fluorometric Rhodamine$^{123}$ assay measuring mitochondrial transmembrane gradient In addition, apoptosis may be monitored for example by FACS-based phosphatidylserin exposure assay, ELISA-based TUNEL test, caspase activity assay (photometric, fluorometric or ELISA-based) or analysing changed cell morphology (shrinking, membrane blebbing). It is preferred that cytotoxic activity is analysed by FACS-based measurements of release of fluorescence-based dyes. In such an assay fluorescence labelled cells, which carry a molecule which binds to the second domain of the cytotoxically active bispecific CD3 binding construct of the invention (preferably, NALM-6 cells for CD19 and Kato cells for the EpCAM antigen) are incubated with isolated PBMCs of random donors or with a standardized T-cell line in the presence of the cytotoxically active bispecific CD3 binding construct of the invention. After incubation, the release of the dye from the fluorescent target cells into the supernatant is determined by a spectrofluorimeter. A cytotoxically active deimmunized bispecific CD3 binding construct of the present invention is characterized by comparing values obtained by measuring the bioactivity of a similar construct which is not deimmunized or has no specificity to the target cells.

The term "binding to/interacting with" as used in the context with the present invention defines a binding/interaction of at least two "antigen-interaction-sites" with each other. The term "antigen-interaction-site" defines, in accordance with the present invention, a motif of a polypeptide which shows the capacity of specific interaction with a specific antigen or a specific group of antigens. Said binding/interaction is also understood to define a "specific recognition". The term "specifically recognizing" means in accordance with this invention that the antibody molecule is capable of specifically interacting with and/or binding to at least two amino acids of each of the human target molecules as defined herein. Antibodies can recognize, interact and/or bind to different epitopes on the same target molecule. Said term relates to the specificity of the antibody molecule, i.e. to its ability to discriminate between the specific regions of the human target molecule as defined herein. The specific interaction of the antigen-interaction-site with its specific antigen may result in an initiation of a signal, e.g. due to the induction of a change of the conformation of the antigen, an oligomerization of the antigen, etc. Thus, a specific motif in the amino acid sequence of the antigen-interaction-site and the antigen bind to each other as a result of their primary, secondary or tertiary structure as well as the result of secondary modifications of said structure.

The term "specific interaction" as used in accordance with the present invention means that the CD3 specific binding construct of the invention does not or essentially does not cross-react with (poly)peptides of similar structures. Accordingly, the construct of the invention specifically binds to/interacts with human CD3 and is capable, due to its second, Ig-derived domain to interact with specific, selected other compounds, antigens, cell surface markers, tumor markers, etc. Specific examples of such molecules against which said second, Ig-derived domain is directed are given herein below.

Cross-reactivity of a panel of constructs under investigation may be tested, for example, by assessing binding of said panel of bispecific single chain constructs under conventional conditions (see, e.g., Harlow and Lane, Antibodies: A Laboratory Manual, Cold Spring Harbor Laboratory Press, 1988 and Using Antibodies: A Laboratory Manual, Cold Spring Harbor Laboratory Press, 1999) to the (poly)peptide of interest as well as to a number of more or less (structurally and/or functionally) closely related (poly)peptides. Only those constructs (i.e. antibodies, (bispecific) scFvs and the like) that bind to the (poly)peptide/protein of interest but do not or do not essentially bind to any of the other (poly)peptides which are preferably expressed by the same tissue as the (poly)peptide of interest, e.g. by the cells of the heart tissue, are considered specific for the (poly)peptide/protein of interest and selected for further studies in accordance with the method provided herein and illustrated in the appended examples. These methods may comprise, inter alia, binding studies, blocking and competition studies with structurally and/or functionally closely related molecules. These binding studies also comprise FACS analysis, surface plasmon resonance (SPR, e.g. with BIAcore®), analytical ultracentrifugation, isothermal titration calorimetry, fluorescence anisotropy, fluorescence spectroscopy or by radiolabeled ligand binding assays. Furthermore, physiological assays, like cytotoxic assays (as illustrated in the examples) and assays mentioned above may be performed. Accordingly, examples for the specific interaction of an antigen-interaction-site with a specific antigen may comprise the specificity of a ligand for its receptor. Said definition particularly comprises the interaction of ligands which induce a signal upon binding to its specific receptor. Examples for corresponding ligands comprise cytokines which interact/bind with/to its specific cytokine-receptors. Also particularly comprised by said definition is the binding of an antigen-interaction-site to antigens such as antigens of the selectin family, integrins and of the family of growth factors like EGF. Another example for said interaction, which is also particularly comprised by said definition, is the interaction of an antigenic determinant (epitope) with the antigenic binding site of an antibody.

The term "binding to/interacting with" relates not only to a linear epitope but may also relate to a conformational epitope, a structural epitope or a discontinuous epitope consisting of two regions of the human target molecules or parts thereof. In context of this invention, a conformational epitope is defined by two or more discrete amino acid sequences separated in the primary sequence which come together on the surface of the molecule when the polypeptide folds to the native protein (Sela, (1969) Science 166, 1365 and Layer, (1990) Cell 61, 553-6).

The term "discontinuous epitope" means in context of the invention non-linear epitopes that are assembled from residues from distant portions of the polypeptide chain. These residues come together on the surface when the polypeptide chain folds into a three-dimensional structure to constitute a conformational/structural epitope.

The constructs of the present invention are also envisaged to specifically bind to/interact with a conformational/structural epitope(s) composed of and/or comprising the two regions of the human CD3 complex described herein or parts thereof as disclosed herein below.

Accordingly, specificity can be determined experimentally by methods known in the art and methods as disclosed and described herein. Such methods comprise, but are not limited to Western blots, ELISA-, RIA-, ECL-, IRMA-tests and peptide scans.

The term "Ig-derived second binding domain" relates to an "immunoglobulin-derived domain", specifically to an antibody or fragments thereof, to single chain antibodies, to synthetic antibodies, to antibody fragments, such as Fab, a F(ab₂)', Fv or scFv fragments etc, or a chemically modified derivative of any of these. These antibodies molecules may be derived from different species or may be of chimeric origin. Most preferably (as documented herein below), said Ig-derived second domain comprised in the CD3 specific binding construct of the invention is a scFv. Antibodies, antibody constructs, antibody fragments, antibody derivatives (all being Ig-derived) to be employed in accordance with the invention or their corresponding immunoglobulin chain(s) can be further modified using conventional techniques known in the art, for example, by using amino acid deletion(s), insertion(s), substitution(s), addition(s), and/or recombination(s) and/or any other modification(s) known in the art either alone or in combination. Methods for introducing such modifications in the DNA sequence underlying the amino acid sequence of an immunoglobulin chain are well known to the person skilled in the art; see, e.g., Sambrook (1989), loc. cit. The term "Ig-derived domain" particularly relates to (poly)peptide constructs comprising at least one CDR. Fragments or derivatives of the recited Ig-derived domains define (poly)peptides which are parts of the above antibody molecules and/or which are modified by chemical/biochemical or molecular biological methods. Corresponding methods are known in the art and described inter alia in laboratory manuals (see Sambrook et al.; Molecular Cloning: A Laboratory Manual; Cold Spring Harbor Laboratory Press, 2nd edition 1989 and 3rd edition 2001; Gerhardt et al.; Methods for General and Molecular Bacteriology; ASM Press, 1994; Lefkovits; Immunology Methods Manual: The Comprehensive Sourcebook of Techniques; Academic Press, 1997; Golemis; Protein-Protein Interactions: A Molecular Cloning Manual; Cold Spring Harbor Laboratory Press, 2002).

The term "deimmunized" as used herein relates to the above-identified first domain of the inventive CD3 binding construct, wherein said first domain is modified compared to an original wildtype construct by rendering said wildtype construct non-immunogenic or less immunogenic in humans. Wildtype constructs according to the invention relate to antibodies or parts thereof (like frameworks and/or CDRs) of non-human origin. Corresponding examples are antibodies or fragments thereof as described in U.S. Pat. No. 4,361,549 or WO 99/54440. The term "deimmunized" also relates to constructs, which show reduced propensity to generate T cell epitopes. In accordance with this invention, the term "reduced propensity to generate T cell epitopes" relates to the removal of T-cell epitopes leading to specific T-cell activation. Furthermore, reduced propensity to generate T cell epitopes means substitution of amino acids contributing to the formation of T cell epitopes, i.e. substitution of amino acids, which are essential for formation of a T cell epitope. In other words, reduced propensity to generate T cell epitopes relates to reduced immunogenicity or reduced capacity to induce antigen independent T cell proliferation. In addition, reduced propensity to generate T cell epitopes relates to deimmunisation, which means loss or reduction of potential T cell epitopes of amino acid sequences inducing antigen independent T cell proliferation. According to the invention, a CD3 binding region, which has reduced propensity to generate T cell epitopes is less or preferably non immunogenic compared to non-deimmunized molecule but which has still retained its capacity to binding to CD3, i.e. a low or non immunogenic antibody construct binding to CD3.

The term "T cell epitope" relates to short peptide sequences which can be released during the degradation of peptides, polypeptides or proteins within cells and subsequently be presented by molecules of the major histocompatibility complex (MHC) in order to trigger the activation of T cells; see inter alia WO 02/066514. For peptides presented by MHC class II such activation of T cells can then give rise to an antibody response by direct stimulation of T cells to produce said antibodies. Accordingly, a deimmunized first domain specifically binding to a human CD3 comprises at least the above mentioned CDR-H3 located between framework H3 and H4, wherein said first binding domain shows a reduced propensity to generate T-cell epitopes compared to a non-deimmunized first domain comprising the unchanged wild-type (wt)-CDR-H3 located between framework H3 and H4. Furthermore, said deimmunized first domain comprises at least in the transition region of the framework H1 and CDR-H1 the above mentioned sequence motif which provides a reduced propensity to generate T-cell epitopes compared to a non-deimmunized first domain comprising the unchanged wt-H1 transition region of the framework H1 and CDR-H1. "Reduced propensity to generate T-cell epitopes" and/or "deimmunization" may be measured by techniques known in the art. Preferably, deimmunization of proteins may be tested in vitro by a T cell proliferation assay. In this assay PBMCs from donors representing >80% of HLA-DR alleles in the world are screened for proliferation in response to either wildtype or deimmunized peptides. Ideally cell proliferation is only detected upon loading of the antigen-presenting cells with wildtype peptides. Alternatively, one may test deimmunization by expressing HLA-DR tetramers representing all haplotypes. These tetramers may be tested for peptide binding or loaded with peptides substitute for antigen-presenting cells in proliferation assays. In order to test if deimmunized peptides are presented on HLA-DR haplotypes, binding of e.g. fluorescence-labeled peptides on PBMCs can be measured. Furthermore, deimmunization can be proven by determining whether antibodies against the deimmunized molecules have been formed after administration in patients. A particular preferred method is a T-cell proliferation assay as, inter alia, shown in appended example 6.

Preferably, antibody derived molecules are deimmunized in the framework regions and most of the CDR regions are not modified in order to generate reduced propensity to induce T cell epitope so that the binding affinity of the CDR regions is not affected. Even elimination of one T cell epitope results in reduced immunogenicity. Preferably, the molecule is deimmunized in the CDR2 region of the VL chain, more preferably in the CDR2 region of the VH chain, even more preferably in the CDR1 region of the VL chain, even more preferably in the CDR1 region of the VH chain, more preferably in the framework region (FR) of the VL chain and most preferably in the framework region (FR) of the VH chain.

The term "CDR" as employed herein relates to "complementary determining region", which is well known in the art. The CDRs are parts of immunoglobulins and T cell receptors that determine the specificity of said molecules and make contact with specific ligand. The CDRs are the most variable part of the molecule and contribute to the diversity of these molecules. There are three CDR regions CDR1, CDR2 and CDR3 in each V domain. CDR-H depicts a CDR region of a variable heavy chain and CDR-L relates to a CDR region of a variable light chain. H means the variable heavy chain and L means the variable light chain. The CDR regions of an Ig-derived region may be determined as described in Kabat (1991). Sequences of Proteins of Immunological Interest, 5th edit., NIH Publication no. 91-3242 U.S. Department of Health and Human Services, Chothia (1987). J. Mol. Biol. 196, 901-917 and Chothia (1989) Nature, 342, 877-883.

In general CDR-L1 consists of 10-17 amino acid residues, starts approximately at amino acid residue 24 of the full VL region of an Ig-derived sequence and the residue Cys precedes the CDR-L1. Preferably, the residue Trp follows CDR-L1. CDR-L2 starts preferably, 16 amino acid residues after CDR-L1 and consists preferably of 7 residues. Preferably, the amino acid residues Ile-Tyr, but also, Val-Tyr, Ile-Lys, Ile-Phe precede CDR-L2. CDR-L3 starts, preferably, 33 amino acid residues after CDR-L2 and consists, preferably, of 7-11 residues. CDR-L3 follows, preferably, the residue Cys and, preferably, the residues Phe-Gly-Xaa-Gly follow directly CDR-L3. CDR-H1 consists of, preferably, 10-12 residues and starts, preferably, approximately at residue 26 from the beginning of the VH region. Preferably, the residue Trp follows CDR-H1. CDR-H2 starts, preferably, 15 amino acid residues after the end of CDR-H1 and consists, preferably, of 16 to 19 residues. Preferably, residues Lys/Arg-Leu/Ile/Val/Phe/Thr/Ala-Thr/Ser/Ile/Ala follow CDR-H2. CDR-H3 starts 33 amino acid residues after CDR-H2 and has a length of 3-25 amino acid residues. CDR-H3 follows the sequence Cys-Xaa-Xaa (preferably Cys-Ala-Arg) and the residues Trp-Gly-Xaa-Gly follow CDR-H3. The structure of CDR regions has been described in bioinf.org.uk/abs.

The above recited CDR-H1 and CDR-H2 regions are derived from antibody molecules which are capable of specifically binding to/interacting with human CD3. Such CD3 specific antibody are known in the art and comprise in particular the monoclonal antibodies OKT-3, TR-66 or X35-3, VIT3, BMA030 (BW264/56), CLB-T3/3, CRIS7, YTH12.5, F111-409, CLB-T3.4.2, TR-66, WT32, SPv-T3b, 11D8, XIII-141, XIII-46, XIII-87, 12F6, T3/RW2-8C8, T3/RW2-4B6, OKT3D, M-T301, SMC2, F101.01, UCHT-1 or WT-31. All the mentioned anti-CD3 antibodies are human specific and in accordance with this invention it is possible to combine various CDR regions, in particular CDRH regions of the antibodies.

In a more preferred embodiment, said CDR-H1 and CDR-H2 regions of said CD3 specific domain with reduced propensity to generate T cell epitopes are derived from the antibody construct described in WO 99/54440. Even more preferred (and as illustrated in the appended examples) said CDR-H1 and CDR-H2 regions, as well as the CDR-H3 region, are derived from an antibody/antibody derivative with specificity for the CD3 molecule described by Traunecker (1991), EMBO J. 10, 3655-3659. In accordance with this invention, said CDR-H1, CDR-H2 and CDR-H3 regions are derived from antibodies/antibody derivatives and the like which are capable of specifically recognizing the human CD3-ϵ chain in the context of other TCR subunits, e.g. in mouse cells transgenic for human CD3-ϵ chain. These transgenic mouse cells express human CD3-ϵ chain in a native or near native conformation.

In accordance with this invention, a framework region relates to a region in the V domain (VH or VL domain) of immunoglobulins and T-cell receptors that provides a protein scaffold for the hypervariable complementarity determining regions (CDRs) that make contact with the antigen. In each V domain, there are four framework regions designated FR1, FR2, FR3 and FR4. Framework 1 encompasses the region from the N-terminus of the V domain until the beginning of CDR1, framework 2 relates to the region between CDR1 and CDR2, framework 3 encompasses the region between CDR2 and CDR3 and framework 4 means the region from the end of CDR3 until the C-terminus of the V domain; see, inter alia, Janeway, Immunobiology, Garland Publishing, 2001, 5th ed. Thus, the framework regions encompass all the regions outside the CDR regions in VH or VL domains. Furthermore, the term "transition sequence between a framework and a CDR region" relates to a direct junction between the framework and CDR region. In particular, the term "transition sequence between a framework and a CDR region" means the sequence directly located N- and C-terminally of the CDR regions or amino acids surrounding CDR regions. Accordingly, frameworks may also comprise sequences between different CDR regions. The person skilled in the art is readily in a position to deduce from a given sequence the framework regions, the CDRs as well as the corresponding transition sequences; see Kabat (1991) Sequences of Proteins of Immunological Interest, 5th edit., NIH Publication no. 91-3242 U.S. Department of Health and Human Services, Chothia (1987). J. Mol. Biol. 196, 901-917 and Chothia (1989) Nature, 342, 877-883.

A preferred cytotoxically active CD3 specific binding construct of the invention further comprises in said first domain a framework H3 comprising the sequence Met-Glu-Leu-Ser (MELS; SEQ ID NO.:234). Even more preferred is an inventive construct which comprises in said first domain a framework H3 comprising the sequence Ile-Thr-Thr-Asp-Lys (ITTDK; SEQ ID NO.: 235).

In accordance with the present invention, the first domain of the inventive construct specifically binding to/interacting with human CD3 and having a reduced propensity to generate T cell epitopes, comprises a CDR-H1, CDR-H2 and CDR-H3 regions as defined herein and, in a preferred embodiment, VH-frameworks (frameworks 1, 2; 3, 4) as defined above, in particular as shown in any one of SEQ ID NOs.: 152 or 153, 156 or 157, 160 or 161 and/or 164 or 165. Therefore, the CD3 specific binding construct of the invention comprises a first domain which specifically binds to human CD3 and comprises a framework region 1 as shown in SEQ ID NO.: 152 or 153, a framework region 2 as shown in SEQ ID NO.: 156 or 157, a framework region 3 as shown in SEQ ID NO.: 160 or 161 and/or a framework region 4 as shown in SEQ ID NO.: 164 or 165.

In a particularly preferred embodiment of the invention, the cytotoxically active deimmunized CD3 specific binding construct comprises in its first domain (a) a CDR-H1 as depicted in SEQ ID NO.: 88; and (b) a CDR-H2 as depicted in SEQ ID NO.: 90 or 92.

Accordingly, the modified CDR-H1 and CDR-H2 regions lead to a reduced propensity to generate T cell epitopes and are derived from an CD3-ε chain specific antibody. Most preferably in accordance with this invention said (parental) antibodies should be capable of specifically binding epitopes reflecting the native or near native structure or a conformational epitope of human CD3 presented in context of the TCR complex.

Preferably, the CD3 specific binding construct of the invention comprises a VH-region as depicted in SEQ ID NO.:74 or 76. SEQ ID NO.:74 shows an illustrative deimmunized variable heavy region and, similarly, SEQ ID NO.:76 shows an illustrative deimmunized variable heavy region.

Preferably, the inventive CD3 specific binding construct comprises a CDR-L1 as depicted in SEQ ID NO.: 98 or 100, a CDR-L2 as depicted in SEQ ID NO.:102 and/or a CDR-L3 as depicted in SEQ ID NO.:104.

The CD3 specific binding construct of the invention comprises, in a preferred embodiment, a VL region in its CD3-specific portion, wherein said VL region is selected from the group consisting of SEQ ID NO.: 78, SEQ ID NO.: 80, SEQ ID NO.: 82 and SEQ ID NO.: 112. VL1 as characterized in SEQ ID NO.:78, VL2 as characterized in SEQ ID NO.:80 and VL 3 as characterized in SEQ ID NO.:82 relate to full deimmunized VL regions in accordance with this invention, and they may be used in various combinations with the above described VH regions. Yet, it is also envisaged that the non-deimmunized VL region may be combined, in accordance with the invention, with deimmunized VH regions defined above. A corresponding non-deimmunized VL-region preferably employed in an cytotoxically active CD3 binding construct of the invention, is shown in SEQ ID NO.: 112. Accordingly, not only heavy chain part of the above recited "first domain" of the inventive CD3 construct may be modified to have a reduced propensity to generate T cell epitopes. It is also envisaged that said domain comprises the corresponding variable light chain parts. SEQ ID NOs.: 78, 80, and 82, for example, depict deimmunized VL1, VL2 and VL3 regions of the CD3 binding part of a construct disclosed in WO 99/54440.

As mentioned above, the CD3 specific binding construct of the invention, most preferably, comprises an Ig-derived second domain which is a scFv. Accordingly, in a most preferred embodiment of the present invention, a deimmunized, bispecific single chain antibody construct is provided with one specificity for human CD3 and a further specificity which is mediated by a second scFv, directed against/capable of interacting with a further molecule/compound. These further molecules/compounds may comprise cell surface molecules, tumor markers, tumor antigens and the like. Such further compounds/molecules are exemplified herein below and specific constructs are also given and provided in the appended examples.

The term "bispecific single chain antibody construct" relates to a construct comprising two antibody derived binding domains, preferably scFvs. One of said binding domains consists of variable regions (or parts thereof) of an antibody, antibody fragment or derivate thereof, capable of specifically binding to/interacting with human CD 3 antigen (target molecule 1). The second binding domain consists of variable regions (or parts thereof) of an antibody, antibody fragment or derivative thereof, capable of specifically binding to/interacting with another (human) antigen (target molecule 2) as defined below. Accordingly, said second binding domain is, in accordance with this invention, the Ig-derived second domain recited above which comprises an antigen-interaction-site with specificity for a cell surface molecule and/or a tumor specific marker. Said two domains/regions in the bispecific construct, preferably said bispecific single chain antibody construct, are preferably covalently connected to one another as a single chain. This connection can be effected either directly (domain 1 [specific for human CD3 antigen, comprising a reduced propensity to generate T cell epitopes and comprising CDR-regions or CDR-regions and framework regions as defined above]-domain 2 [specific for a cell surface molecule and/or a tumor specific marker] or domain 1 [specific for a cell surface molecule and/or a tumor specific marker]-domain 2 [specific for human CD3 antigen, comprising a reduced propensity to generate T cell epitopes and comprising CDR-regions or CDR-regions and framework regions as defined above]) or through an additional polypeptide linker sequence (domain1-linker sequence-domain2). In the event that a linker is used, this linker is preferably of a length and sequence sufficient to ensure that each of the first and second domains can, independently from one another, retain their differential binding specificities. As mentioned above and as documented in the appended examples, preferably, the CD3 specific binding construct comprising at least two domains as defined herein is a "bispecific single chain antibody construct", most preferably a bispecific single chain Fv (scFv). It is in particular envisaged that said construct is employed in context of a pharmaceutical composition. Bispecific single chain molecules are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, J. Immunol., (2001), 166, 2420-2426. A particularly preferred molecular format of the invention provides a polypeptide construct wherein the CD3 specific binding domain of the construct of the invention comprises at least one $V_H$ and one $V_L$ region as defined above. It is of note that in addition to a $V_H$-region as defined herein and having reduced propensity to generate T cell epitopes, said specific binding construct may comprise additional regions/domains with reduced propensity to generate T cell epitopes. As mentioned above, also the VL-region and/or the corresponding frameworks may comprise amino acid stretches which have been engineered in accordance with this invention to having reduced propensity for T cell epitope generation. The intramolecular orientation of the $V_H$-domain and the $V_L$-domain, which are linked to each other by a linker-domain, in the scFv format is not decisive for the recited bispecific single chain constructs. Thus, scFvs with both possible arrangements ($V_H$-domain—linker domain—$V_L$-domain; $V_L$-domain—linker domain—$V_H$-domain) are particular embodiments of the recited bispecific single chain construct. A CD3 specific domain can be located N- or C-terminally in the bispecific molecule. VH and VL regions of each domain can be arranged in different orders ($V_H$—$V_L$ or $V_L$—$V_H$).

The term "single-chain" as used in accordance with the present invention means that said first and second domain of the bispecific single chain construct are covalently linked, preferably in the form of a co-linear amino acid sequence encoded by a single nucleic acid molecule.

It is of note that the construct of the invention may comprise, in addition to the herein defined first domain and the Ig-derived second domain (an) additional domain(s), e.g. for the isolation and/or preparation of recombinantly produced constructs.

It is of note that, in accordance with this invention, not only the above described first domain which specifically binds to human CD3 of the inventive CD3 construct may have reduced propensity to generate T cell epitopes. It is also envisaged that the Ig-derived second domain and/or (a) connecting linker-region(s) is (are) modified, for example humanized and/or also deimmunized.

As mentioned above, deimmunization approaches are in particular illustrated in WO 00/34317, WO 98/52976, WO 02/079415 or WO 02/012899 and the appended examples. These approaches entail carrying out substitutions of amino acids within potential T cell epitopes. In this way, the likelihood that a given sequence will give rise to T cell epitopes upon intracellular protein processing is reduced. In addition, WO 92/10755 describes an approach in which antigenic determinants on proteins are engineered. Particularly, proteins are epitope mapped and their amino acid sequence is changed through genetic engineering.

Furthermore, "humanization approaches" are well known in the art and in particular described for antibody molecules, e.g. Ig-derived molecules. The term "humanized" refers to humanized forms of non-human (e.g., murine) antibodies or fragments thereof (such as Fv, Fab, Fab', F(ab'), scFvs, or other antigen-binding partial sequences of antibodies) which contain some portion of the sequence derived from non-human antibody. Humanized antibodies include human immunoglobulins in which residues from a complementary determining region (CDR) of the human immunoglobulin are replaced by residues from a CDR of a non-human species such as mouse, rat or rabbit having the desired binding specificity, affinity and capacity. In general, the humanized antibody will comprise substantially all of at least one, and generally two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin; see, inter alia, Jones et al., Nature 321:522-525 (1986), Presta, *Curr. Op. Struct. Biol.* 2:593-596 (1992). Methods for humanizing non-human antibodies are well known in the art. Generally, a humanized antibody has one or more amino acids introduced into it from a source which is non-human in order to more closely resemble a human antibody, while still retaining the original binding activity of the antibody. Methods for humanization of antibodies/antibody molecules are further detailed in Jones et al., Nature 321:522-525 (1986); Riechmann et al., *Nature* 332:323-327 (1988); and Verhoeyen et al., *Science* 239:1534-1536 (1988). Specific examples of humanized antibodies, e.g. antibodies directed against EpCAM, are known in the art, see e.g. (LoBuglio, Proceedings of the American Society of Clinical Oncology (Abstract). 1997, 1562 and Khor, Proceedings of the American Society of Clinical Oncology (Abstract), 1997, 847).

Accordingly, in the context of this invention, in particular bispecific single chain antibody constructs are provided, which are deimmunized and can successfully be employed in pharmaceutical compositions.

As mentioned above, the Ig-derived second domain of the above-described CD3 specific binding construct may comprise an antigen-interaction-site with specificity for a cell surface molecule.

The term "cell surface molecule", as used herein, also denotes molecules which are presented on the surface of cells. The term "cell surface molecule", relates to molecules, which are presented on the surface of cells and comprise domains or epitopes accessible (in vitro or in vivo) to Ig-derived binding domains, preferably antibodies, antibody fragments or derivatives. As illustrated above, most preferably said Ig-derived domain is a scFv. Examples for said cell surface molecules are membrane and transmembrane proteins, molecules adapted to said proteins or the cell surface etc. According to a further preferred embodiment of the invention said cell surface molecule is a tumor specific marker. In context of this invention, the term "tumor specific marker" relate to molecules, which are presented and/or located on the surface of tumor cells or which are ubiquitously expressed but are only accessible for binding of antibodies, antibody fragments or antibody derivatives on the surface of tumor cells. Examples of tumor markers are given herein below and comprise, but are not limited to, EpCAM, CD19, HER-2, HER-2 neu, HER-3, HER-4, EGFR, PSMA, CEA, MUC-1 (mucin), MUC2, MUC3, MUC4, $MUC5_{AC}$, $MUC5_B$, MUC7, Lewis-Y, CD20, CD33, CD30, CD44v6, Wue-1, Plasma Cell Antigen (see WO 01/47953), (membrane-bound) IgE, Melanoma Chondroitin Sulfate Proteoglycan (MCSP), STEAP, mesothelin, Prostate Stem Cell Antigen (PSCA), sTn (sialylated Tn antigen), FAP (fibroblast activation antigen), EGFRvIII, Igα, Igβ, MT-MMPs, Cora antigen, EphA2, L6 and CO-29.

The Ig-derived second domain of the CD3 specific binding construct of the invention may also comprise an antigen-interaction site with a specificity for a molecule selected from the group consisting of EpCAM, CCR5, CD19, HER-2, HER-2 neu, HER-3, HER-4, EGFR, PSMA, CEA, MUC-1 (mucin), MUC2, MUC3, MUC4, $MUC5_{AC}$, $MUC5_B$, MUC7, βhCG, Lewis-Y, CD20, CD33, CD30, ganglioside GD3; 9-O-Acetyl-GD3, GM2, Globo H, fucosyl GM1, Poly SA, GD2, Carboanhydrase IX (MN/CA IX), CD44v6, Sonic Hedgehog (Shh), Wue-1, Plasma Cell Antigen, (membrane-bound) IgE, Melanoma Chondroitin Sulfate Proteoglycan (MCSP), CCR8, TNF-alpha precursor, STEAP, mesothelin, A33 Antigen, Prostate Stem Cell Antigen (PSCA), Ly-6; desmoglein 4, E-cadherin neoepitope, Fetal Acetylcholine Receptor, CD25, CA19-9 marker, CA-125 marker and Muellerian Inhibitory Substance (MIS) Receptor type II, sTn (sialylated Tn antigen), FAP (fibroblast activation antigen), endosialin, EGFRvIII, L6, SAS, CD63, TAG72, TF-antigen, Cora antigen, CD7, CD22, Igα (CD79a), Igβ (CD79b), G250, gp100, MT-MMPs, F19-antigen, CO-29 and EphA2.

The constructs provided herein are particular useful in medical setting. For example, tumorous diseases and/or lymphomas, preferably non-Hodgkin's B-cell lymphoma, may be treated with an inventive deimmunized (bispecific) construct directed against human CD3 and CD20 (CD3×CD20 or CD20×CD3). Autoimmune diseases may be treated by the administration of deimmunized (bispecific) constructs directed against human CD3 and CD30 or CD19 (i.e CD3× CD30 or CD30×CD3 or CD3×CD19 or CD19×CD3). Rheumatoid arthritis, as well as other inflammatory diseases may be treated with an inventive deimmunized (bispecific) construct directed against human CD3 and CCR5 (CD3×CCR5 or CCR5×CD3). A deimmunized CD3 specific binding construct as defined herein and comprising a second Ig-derived domain directed to/binding with TNF-alpha precursor may also be useful in the treatment or prevention of inflammatory disorders. CD3 constructs as provided herein and comprising a second, Ig-derived domain directed against/binding to/interacting with EpCAM, CD19, HER-2, HER-2 neu, HER-3, HER-4, EGFR, PSMA, CEA, MUC-1 (mucin), MUC2, MUC3, MUC4, MUC5$_{AC}$, MUC5$_B$, MUC7, Lewis-Y, CD20, CD33, CD30, CD44v6, Wue-1, Plasma Cell Antigen (see WO 01/47953), (membrane-bound) IgE, Melanoma Chondroitin Sulfate Proteoglycan (MCSP), STEAP, mesothelin, Prostate Stem Cell Antigen (PSCA), sTn (sialylated Tn antigen), FAP (fibroblast activation antigen), EGFRvIII, Igα, Igβ, MT-MMPs, Cora antigen, EphA2; L6 and CO-29 may be particularly useful in the medical intervention of tumorous diseases like breast cancer, colon cancer, prostate cancer, head and neck cancer, skin cancer (melanoma), cancers of the genito-urinary tract, e.g. ovarial cancer, endometrial cancer, cervix cancer and kidney cancer, lung cancer, gastric cancer, cancer of the small intestine, liver cancer, pancreas cancer, gall bladder cancer, cancers of the bile duct, esophagus cancer, cancer of the salivatory glands and cancer of the thyroid gland or other tumorous diseases like hematological tumors, gliomas, sarcomas or osteosarcomas. The administration of the CD3 binding constructs is also indicated for minimal residual disease, preferably for early solid tumors, advanced solid tumors or metastatic solid tumors.

As also illustrated in the appended examples, a particularly preferred CD3 specific binding construct of the invention comprises the above defined first domain with reduced propensity to generate T cell epitopes and a second, Ig-derived domain comprising an antigen-interaction site with a specificity for EpCAM.

Epithelial cell adhesion molecule (EpCAM, also called 17-1A antigen, KSA, EGP40, GA733-2, ks1-4 or esa) is a 40-kDa membrane-integrated glycoprotein of 314 amino acids with specific expression in certain epithelia and on many human carcinomas (reviewed in Balzar, J. Mol. Med. 1999, 77, 699-712). EpCAM was discovered and subsequently cloned through its recognition by the murine monoclonal antibody 17-1A/edrecolomab (Goettlinger, Int J. Cancer. 1986; 38, 47-53 and Simon, Proc. Natl. Acad. Sci. USA. 1990; 87, 2755-2759). EpCAM serves to adhere epithelial cells in an oriented and highly ordered fashion (Litvinov, J. Cell Biol. 1997, 139, 1337-1348). Upon malignant transformation of epithelial cells the rapidly growing tumor cells are abandoning the high cellular order of epithelia. Consequently, the surface distribution of EpCAM becomes less restricted and the molecule better exposed on tumor cells and accessible for binding of antibodies, antibody fragments or antibody derivatives on the surface of tumor cells. Due to their epithelial cell origin, tumor cells from most carcinomas still express EpCAM on their surface.

In vivo, expression of EpCAM is related to increased epithelial proliferation and negatively correlates with cell differentiation (for review see Balzar, 1999, J. Mol. Med. 77, 699-712). Expression of EpCAM is essentially seen with all major carcinomas (reviewed in Balzar, J Mol. Med. 1999, 77, 699-712 or documented, inter alia, in De Bree, Nucl Med. Commun. 1994, 15, 613-27; Zhang, Clin Cancer Res. 1998, 4, 295-302). Because of its widespread expression, EpCAM is referred to as a "pan-carcinoma" antigen. In many cases, tumor cells were observed to express EpCAM to a much higher degree than their parental epithelium or less aggressive forms of said cancers. For example, increased EpCAM expression represents an early event in the development of prostate cancer (Poczatek, J. Urol., 1999, 162, 1462-1644). In addition, in the majority of both squamous and adenocarcinomas of the cervix a strong EpCAM expression correlates with an increased proliferation and the disappearance of markers for terminal differentiation (Litvinov, Am. J. Pathol. 1996, 148, 865-75). In breast cancer, overexpression of EpCAM on tumor cells is a predictor of survival (Gastl, Lancet. 2000, 356, 1981-1982). EpCAM is a marker, for the detection of disseminated tumor cells in patients suffering from squamous cell carcinoma of the head, neck and lung (Chaubal, Anticancer Res 1999, 19, 2237-2242, Piyathilake, Hum Pathol. 2000, 31, 482-487). Normal squamous epithelium, as found in epidermis, oral cavity, epiglottis, pharynx, larynx and esophagus did not significantly express EpCAM (Quak, Hybridoma, 1990, 9, 377-387). EpCAM has been shown to be expressed on the majority of primary, metastatic, and disseminated NSCLC (non small cell lung cancer cells (Passlick, Int J Cancer, 2000, 87, 548-552)), on gastric and gastro-oesophageal junction adenocarcinomas (Martin, J Clin Pathol 1999, 52, 701-4) and in cell lines derived from colorectal, pancreatic carcinomas and breast carcinomas (Szala, Proc Natl Acad Sci USA 1990, 87, 3542-6, Packeisen, Hybridoma, 1999, 18, 37-40).

In a most preferred embodiment, the CD3 specific binding construct of the invention which comprises a second Ig-derived domain directed against/binding to EpCAM, comprises an amino acid sequence selected from the group of (a) an amino acid sequence as shown in any one of SEQ ID NO.: 31, 33, 35, 37, 39, 49, 55, 58, 61, 63, 65, 67, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323 and 325;

(b) an amino acid sequence encoded by a nucleic acid sequence as shown in any one of SEQ ID NO.: 30, 32, 34, 36, 38, 48, 54, 57, 60, 62, 64, 66, 236, 238; 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322 and 324; and (c) an amino acid sequence encoded by a nucleic acid sequence which is degenerate as a result of the genetic code to a nucleotide sequence of (b).

Accordingly, the present invention provides, in a particularly preferred embodiment for specific CD3 constructs which comprise a CD3 binding/interaction part ("anti-CD3") which has reduced propensity to generate T cell epitopes and a further single chain part (an Ig-derived domain) which specifically interacts with/binds to EpCAM ("anti-EpCAM"). The following tables 1A, 1B, 2A, 2B, 3A, 3B, 4A, 4B, 5A and 5B relate to preferred configurations of such CD3 and EpCAM binding constructs.

EpCAM 3-1, EpCAM 3-5, EpCAM 4-1, EpCAM 4-7 and EpCAM 5-10 relate, to specific single chain antibodies against EpCAM isolated by phage display in WO99/25818.

Each protein construct in Tables 1A, 2A, 3A, 4A and 5A comprises 7 distinct protein modules, denoted A-G. Protein modules A-G are directly and covalently linked to one another in a single contiguous polypeptide chain by peptide bonds in the order A-B-C-D-E-F-G, with protein module A at the N-terminus and protein module G at the C-terminus. Protein modules A, C, E and G denote antibody variable domains which can be either VH or VL domains of antibodies having specificity for the human CD3 or EpCAM antigen. The modules B, D and F are linkers connecting the VH and VL domains.

If protein module A is a VH antibody domain, then protein module C is a VL protein domain, and vice versa. If protein module E is a VH antibody domain, then protein module G is a VL protein domain, and vice versa.

Deimmunized VH domains of antibodies having specificity for the human CD3 antigen can be selected from the sequences as set out in SEQ ID NOs.: 74 or 76. Deimmunized VL domains of antibodies having specificity for the human CD3 antigen can be selected from the sequences as set out in SEQ ID NOs.: 78, 80 or 82. The VH protein domain of human EpCAM 3-1, 3-5, 4-1, 4-7 and 5-10 antibody is as set out in SEQ ID NO.: 137, 141, 145, 149 and 133, respectively. The VL protein domain of human EpCAM 3-1, 3-5, 4-1, 4-7 and 5-10 antibody is as set out in SEQ ID NO.: 139, 143, 147, 151 and 135, respectively.

Pairs of antibody variable domains denoted by the protein module pairs A/C and E/G are joined by additional linking protein modules, wherein protein module B serves to directly link the module pair A/C and protein module F serves to directly link the module pair E/G. When either the module pair A/C or E/G is a pair of deimmunized VHNL or VL/VH protein domains from an antibody having specificity for the human CD3 antigen, protein module B or F, respectively, has the amino acid sequence as set out in SEQ ID NO.: 3. When either the module pair A/C or E/G is a pair of VHNL or VL/VH from an antibody having specificity for the EpCAM antigen, protein module B or F, respectively, has the amino acid sequence as set out in SEQ ID NO.: 168. The module D connects the ABC and EFG module groups.

The combination of protein modules A-B-C and the combination of protein modules E-F-G each respectively constitute one scFv fragment of an antibody having specificity for either the human CD3 antigen or for the EpCAM antigen. If the modules A and C show the CD3 binding sequence, the respective groups of protein modules A-B-C and E-F-G are connected to each other through protein module D, having the sequence as set out in SEQ ID NO.: 176. On the other hand, if the modules A and C show the EpCAM binding sequence, the respective groups, of protein modules A-B-C and E-F-G are connected to each other through protein module D, having the sequence as set out in SEQ ID NO.: 174. Thus, an additional serine may be inserted after the VL chain for cloning purposes. However, the skilled artisan may also use the linker as shown in SEQ ID NO.:174 in order to link a VL domain with the subsequent V domain instead of SEQ ID NO.:176. Protein module D serves to connect the C-terminal end of protein module C with the N-terminal end of protein module E.

Each nucleic acid construct in Tables 1B, 2B, 3B, 4B and 5B comprises 7 distinct nucleic acid modules, denoted A-G. Nucleic acid modules A-G are directly and covalently linked to one another in a single contiguous nucleotide chain by phosphate glycoside bonds in the order A-B-C-D-E-F-G, with nucleic acid module A at the 5'-end and nucleic acid module G at the 3'-end of a respective nucleic acid construct. Nucleic acid modules A, C, E and G denote encoding regions for antibody variable domains which can be either VH or VL domains of antibodies having specificity for the human CD3 or EpCAM antigen.

If nucleic acid module A encodes a VH antibody domain, then nucleic acid module C encodes a VL protein domain, and vice versa. If nucleic acid module E encodes a VH antibody domain, then nucleic acid module G encodes a VL protein domain, and vice versa.

Nucleic acid molecules encoding deimmunized VH domains of antibodies having specificity for the human CD3 antigen can be selected from the sequences as set out in SEQ ID NOs.: 73 or 75. Nucleic acid molecules encoding deimmunized VL domains of antibodies having specificity for the human CD3 antigen can be selected from the sequences as set out in SEQ ID NOs.: 77, 79 or 81. The nucleic acid molecule encoding the VH protein domain of the human EpCAM 3-1, 3-5, 4-1, 4-7 and 5-10 antibody is as set out in SEQ ID NO.: 136, 140, 144, 148 and 132 respectively. The nucleic acid molecule encoding the VL protein domain of the human EpCAM 3-1, 3-5, 4-1, 4-7 and 5-10 antibody is as set out in SEQ ID NO.: 138, 142, 146, 150 and 134, respectively.

Pairs of nucleic acids encoding antibody variable domains denoted by the nucleic acid module pairs A/C and E/G are joined by additional linking nucleic acid modules, wherein nucleic acid module B serves to directly link the module pair A/C and nucleic acid module F serves to directly link the module pair E/G. When either the module pair NC or E/G denotes nucleic acid encoding a pair of deimmunized VH/VL or VL/VH protein domains from an antibody having specificity for the human CD3 antigen, nucleic acid module B or F, respectively, has the nucleotide sequence as set out in SEQ ID NO.: 202. When either the module pair A/C or E/G denotes nucleic acid encoding a pair of VHNL or VL/VH from an antibody having specificity for the human EpCAM antigen, nucleic acid module B or F, respectively, has the nucleotide sequence as set out in SEQ ID NO.: 201.

The combination of nucleic acid modules A-B-C and the combination of nucleic acid modules E-F-G each respectively constitute one scFv fragment of an antibody having specificity for either the human CD3 antigen or for the EpCAM antigen. If the A and C modules comprise CD3 binding sequences, the respective groups of nucleic acid modules A-B-C and E-F-G are connected to each other through nucleic acid module D, having the nucleotide sequence as set out in SEQ ID NO.: 175. If the A and C modules comprise EpCAM binding sequences, the respective groups of nucleic acid modules A-B-C and E-F-G are connected to each other through nucleic acid module D, having the nucleotide sequence as set out in SEQ ID NO.: 173. However, as mentioned above, the additional codon encoding a serine (in SEQ ID NO.:175) may be inserted for cloning purposes. The skilled person may link the nucleotide sequence encoding the VL chain directly with the subsequent V domain with the linker as depicted in SEQ ID NO.:173 without the additional codon encoding serine at the 5' end of the linker. Nucleic acid module D serves to connect the 3'-end of nucleic acid module C with the 5'-end of nucleic acid module E.

TABLE 1A

Deimmunized anti-human CD3 constructs comprising single chain anti-EpCAM 3-1 variable regions: amino acid sequence

| Construct | SEQ ID NO.: in construct portion ... | | | | | | | deimmunized anti-CD3 construct/Specificity (N -> C) | Domain Arrangement |
| --- | --- | --- | --- | --- | --- | --- | --- | --- | --- |
| | A | B | C | D | E | F | G | | |
| 1 | 80 | 3 | 74 | 176 | 137 | 168 | 139 | CD3 (VL2/VH5) × EPCAM(3-1) | LHHL |
| 2 | 74 | 3 | 80 | 176 | 137 | 168 | 139 | CD3 (VH5/VL2) × EPCAM(3-1) | HLHL |
| 3 | 80 | 3 | 74 | 176 | 139 | 168 | 137 | CD3 (VL2/VH5) × EPCAM(3-1) | LHLH |
| 4 | 74 | 3 | 80 | 176 | 139 | 168 | 137 | CD3 (VH5/VL2) × EPCAM(3-1) | HLLH |
| 5 | 139 | 168 | 137 | 174 | 74 | 3 | 80 | EPCAM(3-1) × CD3 (VH5/VL2) | LHHL |
| 6 | 137 | 168 | 139 | 174 | 74 | 3 | 80 | EPCAM(3-1) × CD3(VH5/VL2) | HLHL |
| 7 | 139 | 168 | 137 | 174 | 80 | 3 | 74 | EPCAM(3-1) × CD3 (VL2/VH5) | LHLH |
| 8 | 137 | 168 | 139 | 174 | 80 | 3 | 74 | EPCAM(3-1) × CD3(VL2/VH5) | HLLH |
| 9 | 80 | 3 | 76 | 176 | 137 | 168 | 139 | CD3 (VL2/VH7) × EPCAM(3-1) | LHHL |
| 10 | 76 | 3 | 80 | 176 | 137 | 168 | 139 | CD3 (VH7/VL2) × EPCAM(3-1) | HLHL |
| 11 | 80 | 3 | 76 | 176 | 139 | 168 | 137 | CD3 (VL2/VH7) × EPCAM(3-1) | LHLH |
| 12 | 76 | 3 | 80 | 176 | 139 | 168 | 137 | CD3 (VH7/VL2) × EPCAM(3-1) | HLLH |
| 13 | 139 | 168 | 137 | 174 | 76 | 3 | 80 | EPCAM(3-1) × CD3 (VH7/VL2) | LHHL |
| 14 | 137 | 168 | 139 | 174 | 76 | 3 | 80 | EPCAM(3-1) × CD3(VH7/VL2) | HLHL |
| 15 | 139 | 168 | 137 | 174 | 80 | 3 | 76 | EPCAM(3-1) × CD3 (VL2/VH7) | LHLH |
| 16 | 137 | 168 | 139 | 174 | 80 | 3 | 76 | EPCAM(3-1) × CD3(VL2/VH7) | HLLH |

TABLE 1B

Deimmunized anti-human CD3 constructs comprising single chain anti-EpCAM 3-1 variable regions: nucleotide sequence

| Construct | SEQ ID NO.: in construct portion ... | | | | | | | deimmunized anti-CD3 construct/Specificity (N -> C) | Domain Arrangement |
| --- | --- | --- | --- | --- | --- | --- | --- | --- | --- |
| | A | B | C | D | E | F | G | | |
| 1 | 79 | 202 | 73 | 175 | 136 | 201 | 138 | CD3 (VL2/VH5) × EPCAM(3-1) | LHHL |
| 2 | 73 | 202 | 79 | 175 | 136 | 201 | 138 | CD3 (VH5/VL2) × EPCAM(3-1) | HLHL |
| 3 | 79 | 202 | 73 | 175 | 138 | 201 | 136 | CD3 (VL2/VH5) × EPCAM(3-1) | LHLH |
| 4 | 73 | 202 | 79 | 175 | 138 | 201 | 136 | CD3 (VH5/NL2) × EPCAM(3-1) | HLLH |
| 5 | 138 | 201 | 136 | 173 | 73 | 202 | 79 | EPCAM(3-1) × CD3 (VH5/VL2) | LHHL |
| 6 | 136 | 201 | 138 | 173 | 73 | 202 | 79 | EPCAM(3-1) × CD3(VH5/VL2) | HLHL |
| 7 | 138 | 201 | 136 | 173 | 79 | 202 | 73 | EPCAM(3-1) × CD3 (VL2/VH5) | LHLH |
| 8 | 136 | 201 | 138 | 173 | 79 | 202 | 73 | EPCAM(3-1) × CD3(VL2/VH5) | HLLH |
| 9 | 79 | 202 | 75 | 175 | 136 | 201 | 138 | CD3 (VL2/VH7) × EPCAM(3-1) | LHHL |
| 10 | 75 | 202 | 79 | 175 | 136 | 201 | 138 | CD3 (VH7/VL2) × EPCAM(3-1) | HLHL |
| 11 | 79 | 202 | 75 | 175 | 138 | 201 | 136 | CD3 (VL2/VH7) × EPCAM(3-1) | LHLH |
| 12 | 75 | 202 | 79 | 175 | 138 | 201 | 136 | CD3 (VH7/VL2) × EPCAM(3-1) | HLLH |
| 13 | 138 | 201 | 136 | 173 | 75 | 202 | 79 | EPCAM(3-1) × CD3 (VH7/VL2) | LHHL |
| 14 | 136 | 201 | 138 | 173 | 75 | 202 | 79 | EPCAM(3-1) × CD3(VH7/VL2) | HLHL |
| 15 | 138 | 201 | 136 | 173 | 79 | 202 | 75 | EPCAM(3-1) × CD3 (VL2/VH7) | LHLH |
| 16 | 136 | 201 | 138 | 173 | 79 | 202 | 75 | EPCAM(3-1) × CD3(VL2/VH7) | HLLH |

TABLE 2A

Deimmunized anti-human CD3 constructs comprising single chain anti-EpCAM 3-5 variable regions: amino acid sequence

| Construct | SEQ ID NO.: in construct portion ... | | | | | | | deimmunized anti-CD3 construct/Specificity (N -> C) | Domain Arrangement |
| --- | --- | --- | --- | --- | --- | --- | --- | --- | --- |
| | A | B | C | D | E | F | G | | |
| 1 | 80 | 3 | 74 | 176 | 141 | 168 | 143 | CD3 (VL2/VH5) × EPCAM (3-5) | LHHL |
| 2 | 74 | 3 | 80 | 176 | 141 | 168 | 143 | CD3 (VH5/VL2) × EPCAM (3-5) | HLHL |
| 3 | 80 | 3 | 74 | 176 | 143 | 168 | 141 | CD3 (VL2/VH5) × EPCAM (3-5) | LHLH |
| 4 | 74 | 3 | 80 | 176 | 143 | 168 | 141 | CD3 (VH5/VL2) × EPCAM (3-5) | HLLH |
| 5 | 143 | 168 | 141 | 174 | 74 | 3 | 80 | EPCAM (3-5) × CD3 (VH5/VL2) | LHHL |
| 6 | 141 | 168 | 143 | 174 | 74 | 3 | 80 | EPCAM (3-5) × CD3 (VH5/VL2) | HLHL |
| 7 | 143 | 168 | 141 | 174 | 80 | 3 | 74 | EPCAM (3-5) × CD3 (VL2/VH5) | LHLH |
| 8 | 141 | 168 | 143 | 174 | 80 | 3 | 74 | EPCAM (3-5) × CD3 (VL2/VH5) | HLLH |
| 9 | 80 | 3 | 76 | 176 | 141 | 168 | 143 | CD3 (VL2/VH7) × EPCAM (35) | LHHL |
| 10 | 76 | 3 | 80 | 176 | 141 | 168 | 143 | CD3 (VH7/VL2) × EPCAM (3-5) | HLHL |
| 11 | 80 | 3 | 76 | 176 | 143 | 168 | 141 | CD3 (VL2/VH7) × EPCAM (3-5) | LHLH |
| 12 | 76 | 3 | 80 | 176 | 143 | 168 | 141 | CD3 (VH7/VL2) × EPCAM (3-5) | HLLH |
| 13 | 143 | 168 | 141 | 174 | 76 | 3 | 80 | EPCAM (3-5) × CD3 (VH7/VL2) | LHHL |
| 14 | 141 | 168 | 143 | 174 | 76 | 3 | 80 | EPCAM (3-5) × CD3 (VH7/VL2) | HLHL |
| 15 | 143 | 168 | 141 | 174 | 80 | 3 | 76 | EPCAM (3-5) × CD3 (VL2/VH7) | LHLH |
| 16 | 141 | 168 | 143 | 174 | 80 | 3 | 76 | EPCAM (3-5) × CD3 (VL2/VH7) | HLLH |

TABLE 2B

Deimmunized anti-human CD3 constructs comprising single chain anti-EpCAM 3-5 variable regions: nucleotide sequence

| Construct | SEQ ID NO.: in construct portion . . . | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 79 | 202 | 73 | 175 | 140 | 201 | 142 | CD3 (VL2/VH5) × EPCAM (3-5) | LHHL |
| 2 | 73 | 202 | 79 | 175 | 140 | 201 | 142 | CD3 (VH5/VL2) × EPCAM (3-5) | HLHL |
| 3 | 79 | 202 | 73 | 175 | 142 | 201 | 140 | CD3 (VL2/VH5) × EPCAM (3-5) | LHLH |
| 4 | 73 | 202 | 79 | 175 | 142 | 201 | 140 | CD3 (VH5/VL2) × EPCAM (3-5) | HLLH |
| 5 | 142 | 201 | 140 | 173 | 73 | 202 | 79 | EPCAM (3-5) × CD3 (VH5/VL2) | LHHL |
| 6 | 140 | 201 | 142 | 173 | 73 | 202 | 79 | EPCAM (3-5) × CD3 (VH5/VL2) | HLHL |
| 7 | 142 | 201 | 140 | 173 | 79 | 202 | 73 | EPCAM (3-5) × CD3 (VL2/VH5) | LHLH |
| 8 | 140 | 201 | 142 | 173 | 79 | 202 | 73 | EPCAM (3-5) × CD3 (VL2/VH5) | HLLH |
| 9 | 79 | 202 | 75 | 175 | 140 | 201 | 142 | CD3 (VL2/VH7) × EPCAM (3-5) | LHHL |
| 10 | 75 | 202 | 79 | 175 | 140 | 201 | 142 | CD3 (VH7/VL2) × EPCAM (3-5) | HLHL |
| 11 | 79 | 202 | 75 | 175 | 142 | 201 | 140 | CD3 (VL2/VH7) × EPCAM (3-5) | LHLH |
| 12 | 75 | 202 | 79 | 175 | 142 | 201 | 140 | CD3 (VH7/VL2) × EPCAM (3-5) | HLLH |
| 13 | 142 | 201 | 140 | 173 | 75 | 202 | 79 | EPCAM (3-5) × CD3 (VH7/VL2) | LHHL |
| 14 | 140 | 201 | 142 | 173 | 75 | 202 | 79 | EPCAM (3-5) × CD3 (VH7/VL2) | HLHL |
| 15 | 142 | 201 | 140 | 173 | 79 | 202 | 75 | EPCAM (3-5) × CD3 (VL2/VH7) | LHLH |
| 16 | 140 | 201 | 142 | 173 | 79 | 202 | 75 | EPCAM (3-5) × CD3 (VL2/VH7) | HLLH |

TABLE 3A

Deimmunized anti-human CD3 constructs comprising single chain anti-EpCAM 4-1 variable regions: amino acid sequence

| Construct | SEQ ID NO.: in construct portion . . . | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 80 | 3 | 74 | 176 | 145 | 168 | 147 | CD3 (VL2/VH5) × EPCAM (4-1) | LHHL |
| 2 | 74 | 3 | 80 | 176 | 145 | 168 | 147 | CD3 (VH5/VL2) × EPCAM (4-1) | HLHL |
| 3 | 80 | 3 | 74 | 176 | 147 | 168 | 145 | CD3 (VL2/VH5) × EPCAM (4-1) | LHLH |
| 4 | 74 | 3 | 80 | 176 | 147 | 168 | 145 | CD3 (VH5/VL2) × EPCAM (4-1) | HLLH |
| 5 | 147 | 168 | 145 | 174 | 74 | 3 | 80 | EPCAM (4-1) × CD3 (VH5/VL2) | LHHL |
| 6 | 145 | 168 | 147 | 174 | 74 | 3 | 80 | EPCAM (4-1) × CD3 (VH5/VL2) | HLHL |
| 7 | 147 | 168 | 145 | 174 | 80 | 3 | 74 | EPCAM (4-1) × CD3 (VL2/VH5) | LHLH |
| 8 | 145 | 168 | 147 | 174 | 80 | 3 | 74 | EPCAM (4-1) × CD3 (VL2/VH5) | HLLH |
| 9 | 80 | 3 | 76 | 176 | 145 | 168 | 147 | CD3 (VL2/VH7) × EPCAM (4-1) | LHHL |
| 10 | 76 | 3 | 80 | 176 | 145 | 168 | 147 | CD3 (VH7/VL2) × EPCAM (4-1) | HLHL |
| 11 | 80 | 3 | 76 | 176 | 147 | 168 | 145 | CD3 (VL2/VH7) × EPCAM (4-1) | LHLH |
| 12 | 76 | 3 | 80 | 176 | 147 | 168 | 145 | CD3 (VH7/VL2) × EPCAM (4-1) | HLLH |
| 13 | 147 | 168 | 145 | 174 | 76 | 3 | 80 | EPCAM (4-1) × CD3 (VH7/VL2) | LHHL |
| 14 | 145 | 168 | 147 | 174 | 76 | 3 | 80 | EPCAM (4-1) × CD3 (VH7/VL2) | HLHL |
| 15 | 147 | 168 | 145 | 174 | 80 | 3 | 76 | EPCAM (4-1) × CD3 (VL2/VH7) | LHLH |
| 16 | 145 | 168 | 147 | 174 | 80 | 3 | 76 | EPCAM (4-1) × CD3 (VL2/VH7) | HLLH |

TABLE 3B

Deimmunized anti-human CD3 constructs comprising single chain anti-EpCAM 4-1 variable regions: nucleotide sequence

| Construct | SEQ ID NO.: in construct portion . . . | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 79 | 202 | 73 | 175 | 144 | 201 | 146 | CD3 (VL2/VH5) × EPCAM (4-1) | LHHL |
| 2 | 73 | 202 | 79 | 175 | 144 | 201 | 146 | CD3 (VH5/VL2) × EPCAM (4-1) | HLHL |
| 3 | 79 | 202 | 73 | 175 | 146 | 201 | 144 | CD3 (VL2/VH5) × EPCAM (4-1) | LHLH |
| 4 | 73 | 202 | 79 | 175 | 146 | 201 | 144 | CD3 (VH5/VL2) × EPCAM (4-1) | HLLH |
| 5 | 146 | 201 | 144 | 173 | 73 | 202 | 79 | EPCAM (4-1) × CD3 (VH5/VL2) | LHHL |
| 6 | 144 | 201 | 146 | 173 | 73 | 202 | 79 | EPCAM (4-1) × CD3 (VH5/VL2) | HLHL |
| 7 | 146 | 201 | 144 | 173 | 79 | 202 | 73 | EPCAM (4-1) × CD3 (VL2/VH5) | LHLH |
| 8 | 144 | 201 | 146 | 173 | 79 | 202 | 73 | EPCAM (4-1) × CD3 (VL2/VH5) | HLLH |
| 9 | 79 | 202 | 75 | 175 | 144 | 201 | 146 | CD3 (VL2/VH7) × EPCAM (4-1) | LHHL |
| 10 | 75 | 202 | 79 | 175 | 144 | 201 | 146 | CD3 (VH7/VL2) × EPCAM (4-1) | HLHL |
| 11 | 79 | 202 | 75 | 175 | 146 | 201 | 144 | CD3 (VL2/VH7) × EPCAM (4-1) | LHLH |
| 12 | 75 | 202 | 79 | 175 | 146 | 201 | 144 | CD3 (VH7/VL2) × EPCAM (4-1) | HLLH |
| 13 | 146 | 201 | 144 | 173 | 75 | 202 | 79 | EPCAM (4-1) × CD3 (VH7/VL2) | LHHL |
| 14 | 144 | 201 | 146 | 173 | 75 | 202 | 79 | EPCAM (4-1) × CD3 (VH7/VL2) | HLHL |
| 15 | 146 | 201 | 144 | 173 | 79 | 202 | 75 | EPCAM (4-1) × CD3 (VL2/VH7) | LHLH |
| 16 | 144 | 201 | 146 | 173 | 79 | 202 | 75 | EPCAM (4-1) × CD3 (VL2/VH7) | HLLH |

TABLE 4A

Deimmunized anti-human CD3 constructs comprising single chain anti-EpCAM 4-7 variable regions: amino acid sequence

| Construct | \_\_\_\_\_SEQ ID NO.: in construct portion . . .\_\_\_\_\_ | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 80 | 3 | 74 | 176 | 149 | 168 | 151 | CD3 (VL2/VH5) × EPCAM (4-7) | LHHL |
| 2 | 74 | 3 | 80 | 176 | 149 | 168 | 151 | CD3 (VH5/VL2) × EPCAM (4-7) | HLHL |
| 3 | 80 | 3 | 74 | 176 | 151 | 168 | 149 | CD3 (VL2/VH5) × EPCAM (4-7) | LHLH |
| 4 | 74 | 3 | 80 | 176 | 151 | 168 | 149 | CD3 (VH5/VL2) × EPCAM (4-7) | HLLH |
| 5 | 151 | 168 | 149 | 174 | 74 | 3 | 80 | EPCAM (4-7) × CD3 (VH5/VL2) | LHHL |
| 6 | 149 | 168 | 151 | 174 | 74 | 3 | 80 | EPCAM (4-7) × CD3 (VH5/VL2) | HLHL |
| 7 | 151 | 168 | 149 | 174 | 80 | 3 | 74 | EPCAM (4-7) × CD3 (VL2/VH5) | LHLH |
| 8 | 149 | 168 | 151 | 174 | 80 | 3 | 74 | EPCAM (4-7) × CD3 (VL2/VH5) | HLLH |
| 9 | 80 | 3 | 76 | 176 | 149 | 168 | 151 | CD3 (VL2/VH7) × EPCAM (4-7) | LHHL |
| 10 | 76 | 3 | 80 | 176 | 149 | 168 | 151 | CD3 (VH7/VL2) × EPCAM (4-7) | HLHL |
| 11 | 80 | 3 | 76 | 176 | 151 | 168 | 149 | CD3 (VL2/VH7) × EPCAM (4-7) | LHLH |
| 12 | 76 | 3 | 80 | 176 | 151 | 168 | 149 | CD3 (VH7/VL2) × EPCAM (4-7) | HLLH |
| 13 | 151 | 168 | 149 | 174 | 76 | 3 | 80 | EPCAM (4-7) × CD3 (VH7/VL2) | LHHL |
| 14 | 149 | 168 | 151 | 174 | 76 | 3 | 80 | EPCAM (4-7) × CD3 (VH7/VL2) | HLHL |
| 15 | 151 | 168 | 149 | 174 | 80 | 3 | 76 | EPCAM (4-7) × CD3 (VL2/VH7) | LHLH |
| 16 | 149 | 168 | 151 | 174 | 80 | 3 | 76 | EPCAM (4-7) × CD3 (VL2/VH7) | HLLH |

TABLE 4B

Deimmunized anti-human CD3 constructs comprising single chain anti-EpCAM 4-7 variable regions: nucleotide sequence

| Construct | \_\_\_\_\_SEQ ID NO.: in construct portion . . .\_\_\_\_\_ | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 79 | 202 | 73 | 175 | 148 | 201 | 150 | CD3 (VL2/VH5) × EPCAM (4-7) | LHHL |
| 2 | 73 | 202 | 79 | 175 | 148 | 201 | 150 | CD3 (VH5/VL2) × EPCAM (4-7) | HLHL |
| 3 | 79 | 202 | 73 | 175 | 150 | 201 | 148 | CD3 (VL2/VH5) × EPCAM (4-7) | LHLH |
| 4 | 73 | 202 | 79 | 175 | 150 | 201 | 148 | CD3 (VH5/VL2) × EPCAM (4-7) | HLLH |
| 5 | 150 | 201 | 148 | 173 | 73 | 202 | 79 | EPCAM (4-7) × CD3 (VH5/VL2) | LHHL |
| 6 | 148 | 201 | 150 | 173 | 73 | 202 | 79 | EPCAM (4-7) × CD3 (VH5/VL2) | HLHL |
| 7 | 150 | 201 | 148 | 173 | 79 | 202 | 73 | EPCAM (4-7) × CD3 (VL2/VH5) | LHLH |
| 8 | 148 | 201 | 150 | 173 | 79 | 202 | 73 | EPCAM (4-7) × CD3 (VL2/VH5) | HLLH |
| 9 | 79 | 202 | 75 | 175 | 148 | 201 | 150 | CD3 (VL2/VH7) × EPCAM (4-7) | LHHL |
| 10 | 75 | 202 | 79 | 175 | 148 | 201 | 150 | CD3 (VH7/VL2) × EPCAM (4-7) | HLHL |
| 11 | 79 | 202 | 75 | 175 | 150 | 201 | 148 | CD3 (VL2/VH7) × EPCAM (4-7) | LHLH |
| 12 | 75 | 202 | 79 | 175 | 150 | 201 | 148 | CD3 (VH7/VL2) × EPCAM (4-7) | HLLH |
| 13 | 150 | 201 | 148 | 173 | 75 | 202 | 79 | EPCAM (4-7) × CD3 (VH7/VL2) | LHHL |
| 14 | 148 | 201 | 150 | 173 | 75 | 202 | 79 | EPCAM (4-7) × CD3 (VH7/VL2) | HLHL |
| 15 | 150 | 201 | 148 | 173 | 79 | 202 | 75 | EPCAM (4-7) × CD3 (VL2/VH7) | LHLH |
| 16 | 148 | 201 | 150 | 173 | 79 | 202 | 75 | EPCAM (4-7) × CD3 (VL2/VH7) | HLLH |

TABLE 5A

Deimmunized anti-human CD3 constructs comprising single chain anti-EpCAM 5-10 variable regions: amino acid sequence

| Construct | \_\_\_\_\_SEQ ID NO.: in construct portion . . .\_\_\_\_\_ | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 80 | 3 | 74 | 176 | 133 | 168 | 135 | CD3 (VL2/VH5) × EPCAM (5-10) | LHHL |
| 2 | 74 | 3 | 80 | 176 | 133 | 168 | 135 | CD3 (VH5/VL2) × EPCAM (5-10) | HLHL |
| 3 | 80 | 3 | 74 | 176 | 135 | 168 | 133 | CD3 (VL2/VH5) × EPCAM (5-10) | LHLH |
| 4 | 74 | 3 | 80 | 176 | 135 | 168 | 133 | CD3 (VH5/VL2) × EPCAM (5-10) | HLLH |
| 5 | 135 | 168 | 133 | 174 | 74 | 3 | 80 | EPCAM (5-10) × CD3 (VH5/VL2) | LHHL |
| 6 | 133 | 168 | 135 | 174 | 74 | 3 | 80 | EPCAM (5-10) × CD3 (VH5/VL2) | HLHL |
| 7 | 135 | 168 | 133 | 174 | 80 | 3 | 74 | EPCAM (5-10) × CD3 (VL2/VH5) | LHLH |
| 8 | 133 | 168 | 135 | 174 | 80 | 3 | 74 | EPCAM (5-10) × CD3 (VL2/VH5) | HLLH |
| 9 | 80 | 3 | 76 | 176 | 133 | 168 | 135 | CD3 (VL2/VH7) × EPCAM (5-10) | LHHL |
| 10 | 76 | 3 | 80 | 176 | 133 | 168 | 135 | CD3 (VH7/VL2) × EPCAM (5-10) | HLHL |
| 11 | 80 | 3 | 76 | 176 | 135 | 168 | 133 | CD3 (VL2/VH7) × EPCAM (5-10) | LHLH |
| 12 | 76 | 3 | 80 | 176 | 135 | 168 | 133 | CD3 (VH7/VL2) × EPCAM (5-10) | HLLH |
| 13 | 135 | 168 | 133 | 174 | 76 | 3 | 80 | EPCAM (5-10) × CD3 (VH7/VL2) | LHHL |
| 14 | 133 | 168 | 135 | 174 | 76 | 3 | 80 | EPCAM (5-10) × CD3 (VH7/VL2) | HLHL |
| 15 | 135 | 168 | 133 | 174 | 80 | 3 | 76 | EPCAM (5-10) × CD3 (VL2/VH7) | LHLH |
| 16 | 133 | 168 | 135 | 174 | 80 | 3 | 76 | EPCAM (5-10) × CD3 (VL2/VH7) | HLLH |

TABLE 5B

Deimmunized anti-human CD3 constructs comprising single chain anti-EpCAM 5-10 variable regions: nucleotide sequence

| Construct | SEQ ID NO.: in construct portion . . . | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 79 | 202 | 73 | 175 | 132 | 201 | 134 | CD3 (VL2/VH5) × EPCAM (5-10) | LHHL |
| 2 | 73 | 202 | 79 | 175 | 132 | 201 | 134 | CD3 (VH5/VL2) × EPCAM (5-10) | HLHL |
| 3 | 79 | 202 | 73 | 175 | 134 | 201 | 132 | CD3 (VL2/VH5) × EPCAM (5-10) | LHLH |
| 4 | 73 | 202 | 79 | 175 | 134 | 201 | 132 | CD3 (VH5/VL2) × EPCAM (5-10) | HLLH |
| 5 | 134 | 201 | 132 | 173 | 73 | 202 | 79 | EPCAM (5-10) × CD3 (VH5/VL2) | LHHL |
| 6 | 132 | 201 | 134 | 173 | 73 | 202 | 79 | EPCAM (5-10) × CD3 (VH5/VL2) | HLHL |
| 7 | 134 | 201 | 132 | 173 | 79 | 202 | 73 | EPCAM (5-10) × CD3 (VL2/VH5) | LHLH |
| 8 | 132 | 201 | 134 | 173 | 79 | 202 | 73 | EPCAM (5-10) × CD3 (VL2/VH5) | HLLH |
| 9 | 79 | 202 | 75 | 175 | 132 | 201 | 134 | CD3 (VL2/VH7) × EPCAM (5-10) | LHHL |
| 10 | 75 | 202 | 79 | 175 | 132 | 201 | 134 | CD3 (VH7/VL2) × EPCAM (5-10) | HLHL |
| 11 | 79 | 202 | 75 | 175 | 134 | 201 | 132 | CD3 (VL2/VH7) × EPCAM (5-10) | LHLH |
| 12 | 75 | 202 | 79 | 175 | 134 | 201 | 132 | CD3 (VH7/VL2) × EPCAM (5-10) | HLLH |
| 13 | 134 | 201 | 132 | 173 | 75 | 202 | 79 | EPCAM (5-10) × CD3 (VH7/VL2) | LHHL |
| 14 | 132 | 201 | 134 | 173 | 75 | 202 | 79 | EPCAM (5-10) × CD3 (VH7/VL2) | HLHL |
| 15 | 134 | 201 | 132 | 173 | 79 | 202 | 75 | EPCAM (5-10) × CD3 (VL2/VH7) | LHLH |
| 16 | 132 | 201 | 134 | 173 | 79 | 202 | 75 | EPCAM (5-10) × CD3 (VL2/VH7) | HLLH |

Most preferably, the invention provides bispecific antibody constructs comprising a specificity binding to CD3 and EpCAM and having the SEQ ID NO.:30, 31 (construct 2 of Table 1A and 1B), Seq ID NO.: 48, 49 (construct 5 of the Table 1A, 1B), SEQ ID NO.: 64, 65 (construct 2 of Table 2A, 2B), SEQ ID NO.: 54, 55 (construct 5 of Table 2A, 2B), Seq ID NO.: 66, 67 (construct 2 of Table 3A, 3B), SEQ ID NO.: 32, 33 (construct 2 of Table 4A, 4B), SEQ ID NO.:34, 35 (construct 4 of Table 4A, 4B), SEQ ID NO.: 60, 61 (construct 5 of Table 4A, 4B), SEQ ID NO.: 36, 37 (construct 2 of Table 5A, 5B), SEQ ID NO.: 38, 39 (construct 4 of Table 5A, 5B) or SEQ ID NO.:62, 63 (construct 5 of Table 5A, 5B).

In accordance with constructs provided herein above, particularly preferred CD3 and EpCAM binding constructs of the invention, comprising at least the above described first domain with reduced propensity for T cell epitope generation and specificity for human CD3 and a second, Ig-derived domain which is specific for EpCAM are shown in SEQ ID NOs.: 31, 33, 35, 37, 39, 49, 55, 58, 61, 63, 65, 67, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323 and 325. Corresponding nucleic acid molecules encoding said preferred CD3 and EpCAM binding constructs as defined herein comprise SEQ ID NOs.: 30, 32, 34, 36, 38, 48, 54, 57, 60, 62, 64, 66, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322 and 324.

Accordingly, the present invention also provides for CD3 specific binding constructs comprising a first domain which specifically binds to human CD3 and has reduced propensity to generate T cell epitopes and comprising an Ig-derived second domain directed against/capable of binding to EpCAM, selected from the group consisting of (a) an amino acid sequence as shown in any one of SEQ ID NO.: 31, 33, 35, 37, 39, 49, 55, 58, 61, 63, 65, 67, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323 or 325;

(b) an amino acid sequence encoded by a nucleic acid sequence as shown in any one of SEQ ID NO.: 30, 32, 34, 36, 38, 48, 54, 57, 60, 62, 64, 66, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322 or 324;

(c) an amino acid sequence encoded by a nucleic acid sequence which is degenerate as a result of the genetic code to a nucleotide sequence of (b);

(d) an amino acid sequence encoded by a nucleic acid sequence hybridizing with the complementary strand of a nucleic acid sequence as defined in (b) under stringent hybridization conditions.

The present invention also provides for CD3 specific binding constructs comprising a first domain which specifically binds to human CD3 and has reduced propensity to generate T cell epitopes and comprising an Ig-derived second domain directed against/capable of binding to EpCAM, which comprise an amino acid sequence encoded by a nucleic acid sequence hybridizing with the complementary strand of a nucleic acid sequence as defined in (b) herein above, i.e. to a nucleic acid sequence as shown in any one of SEQ ID NO.: 30, 32, 34, 36, 38, 48, 54, 57, 60, 62, 64, 66, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322 or 324 under stringent hybridization conditions.

The term "hybridizing" as used herein refers to polynucleotides/nucleic acid sequences which are capable of hybridizing to the polynucleotides encoding the deimmunized constructs as defined herein. Therefore, said polynucleotides may be useful as probes in Northern or Southern Blot analysis of RNA or DNA preparations, respectively, or can be used as oligonucleotide primers in PCR analysis dependent on their respective size. Preferably, said hybridizing polynucleotides comprise at least 10, more preferably at least 15 nucleotides in length while a hybridizing polynucleotide of the present invention to be used as a probe preferably comprises at least 100, more preferably at least 200, or most preferably at least 500 nucleotides in length.

It is well known in the art how to perform hybridization experiments with nucleic acid molecules, i.e. the person skilled in the art knows what hybridization conditions s/he has to use in accordance with the present invention. Such hybridization conditions are referred to in standard text books such as Molecular Cloning A Laboratory Manual, Cold Spring Harbor Laboratory (2001) N.Y. Preferred in accordance with the present inventions are polynucleotides which are capable of hybridizing to the polynucleotides of the invention or parts thereof, under stringent hybridization conditions.

"Stringent hybridization conditions" refer, i.e. to an overnight incubation at 42° C. in a solution comprising 50% formamide, 5×SSC (750 mM NaCl, 75 mM sodium citrate), 50 mM sodium phosphate (pH 7.6), 5×Denhardt's solution, 10% dextran sulfate, and 20 µg/ml denatured, sheared salmon sperm DNA, followed by washing the filters in 0.1×SSC at about 65° C. Also contemplated are nucleic acid molecules that hybridize to the polynucleotides of the invention at lower stringency hybridization conditions. Changes in the stringency of hybridization and signal detection are primarily accomplished through the manipulation of formamide concentration (lower percentages of formamide result in lowered stringency); salt conditions, or temperature. For example, lower stringency conditions include an overnight incubation at 37° C. in a solution comprising 6×SSPE (20×SSPE=3M NaCl; 0.2M $NaH_2PO_4$; 0.02M EDTA, pH 7.4), 0.5% SDS, 30% formamide, 100 µg/ml salmon sperm blocking DNA; followed by washes at 50° C. with 1×SSPE, 0.1% SDS. In addition, to achieve even lower stringency, washes performed following stringent hybridization can be done at higher salt concentrations (e.g. 5×SSC). It is of note that variations in the above conditions may be accomplished through the inclusion and/or substitution of alternate blocking reagents used to suppress background in hybridization experiments. Typical blocking reagents include Denhardt's reagent, BLOTTO, heparin, denatured salmon sperm DNA, and commercially available proprietary formulations. The inclusion of specific blocking reagents may require modification of the hybridization conditions described above, due to problems with compatibility.

The recited nucleic acid molecules may be, e.g., DNA, cDNA, RNA or synthetically produced DNA or RNA or a recombinantly produced chimeric nucleic acid molecule comprising any of those polynucleotides either alone or in combination. The deimmunized CD3 and EpCAM binding constructs provided in this invention are particularly useful in medical settings, for example in the prevention, treatment and/or the amelioration of tumorous diseases, in particular, breast cancer, colon cancer, prostate cancer, head and neck cancer, skin cancer (melanoma), cancers of the genito-urinary tract, e.g. ovarial cancer, endometrial cancer, cervix cancer and kidney cancer, lung cancer, gastric cancer, cancer of the small intestine, liver cancer, pancreas cancer, gall bladder cancer, cancers of the bile duct, esophagus cancer, cancer of the salivatory glands and cancer of the thyroid gland. In particular, the deimmunized constructs binding CD3 and EpCAM can be used for the treatment, of epithelial cancer, preferably adenocarcinomas, or minimal residual disease, more preferably early solid tumor, advanced solid tumor or metastatic solid tumor.

In a more particularly preferred embodiment of the CD3 specific binding construct described herein, said construct comprises a second Ig-derived domain which comprises an antigen-interaction site with a specificity for CCR5.

The chemokine receptor CCR5 is a member of a large family of G protein coupled seven transmembrane domain receptors that binds the proinflammatory chemokines RANTES, MIP1-α, MIP1-β and MCP-2. Chemokines act in concert with adhesion molecules to induce the extravasation of leukocytes and to direct their migration to sites of tissue injury. CCR5 is expressed on a minority of T-cells and monocytes and is further the major co-receptor for M-trophic HIV-1 strains that predominate early in the course of an HIV-infection.

Human immunodeficiency virus (HIV) cannot enter human cells unless it first binds to two key molecules on the cell surface, CD4 and a co-receptor. The co-receptor that is initially recognized is CCR5, later in the life cycle of the virus another chemokine receptor CXCR4 becomes the co-receptor for HIV-1 (D'Souza, Nature Med. 2, 1293 (1996); Premack, Nature Med. 2, 1174; Fauci, Nature 384, 529 (1996)). The HIV-1 strains that cause most transmissions of viruses by sexual contact are called M-tropic viruses. These HIV-1 strains (also known as non-syncytia inducing (NSI) primary viruses) can replicate in primary CD4+ T-cells and macrophages and use the chemokine receptor CCR5 (and, less often, CCR3) as their coreceptor. The T-tropic viruses (sometimes called syncytia inducing (SI) primary visuses) can also replicate in primary CD4+ T-cells but can in addition infect established CD4+ T-cell lines in vitro, which they do via the chemokine receptor CXCR4 (fusin). Many of these T-tropic strains can use CCR5 in addition to CXCR4, and some can enter macrophages via CCR5, at least under certain in vitro conditions (D'Souza, Nature Med. 2, 1293 (1996); Premack, Nature Med. 2, 1174; Fauci, Nature 384, 529 (1996)). Whether other coreceptors contribute to HIV-1 pathogenesis is unresolved, but the existence of another coreceptor for some T-tropic strains can be inferred from in vitro studies. Because M-tropic HIV-1 strains are implicated in about 90% of sexual transmissions of HIV, CCR5 is the predominant coreceptor for the virus in patients; transmission (or systemic establishment) of CXCR4-using (T-tropic) strains is rare (D'Souza, Nature Med. 2, 1293 (1996); Premack, Nature Med. 2, 1174; Fauci, Nature 384, 529 (1996), Paxton, Nature Med. 2, 412 (1996); Liu, Cell 86, 367 (1996); Samson, Nature 382, 722 (1996); Dean, Science 273, 1856 (1996); Huang, Nature Med. 2, 1240 (1996)). However, once SI viruses evolve in vivo (or if they are transmitted), they are especially virulent and cause faster disease progression (D'Souza, Nature Med. 2, 1293 (1996); Premack, Nature Med. 2, 1174; Fauci, Nature 384, 529 (1996), Schuitemaker, J. Virol. 66, 1354 (1992); Connor, J. Virol. 67, 1772 (1993); Richman, J. Infect. Dis. 169, 968 (1994); R. I. Connor et al., J. Exp. Med. 185, 621 (1997); Trkola, Nature 384, 184 (1996)).

The numbers and identity of coreceptor molecules on target cells, and the ability of HIV-1 strains to likely enter cells via the different coreceptors, seem to be critical determinants of disease progression. These factors are major influences on both host- and virus-dependent aspects of HIV-1 infection. For example, a homozygous defect (delta 32) in CCR5 correlates strongly with resistance to HIV-1 infection in vivo and in vitro. Individuals who are heterozygous for a defective CCR5 allele are at best weakly protected against infection and have only a modestly slowed disease progression (Paxton, Nature Med. 2, 412 (1996); Liu, Cell 86, 367 (1996); Samson, Nature 382, 722 (1996); Dean, Science 273, 1856 (1996); Huang et al., Nature Med. 2, 1240 (1996)). However, other factors can influence the level of CCR5 expression on activated CD4+ T-cells and thereby affect the efficiency of HIV-1 infection in vitro (Trkola, Nature 384, 184 (1996); Bleul, Proc. Natl. Acad. Sci. U.S.A. 94, 1925 (1997)).

For multiple sclerosis it was shown that CCR5 and CXCR3 are predominantly expressed on T-cells infiltrating demyelinating brain lesions, as well as in the peripheral blood of affected patients. Elimination of the T-cells would block the T-Cell arm of this autoimmune disease.

High expression of CCR3 and CCR5 was also observed in T cells and B cells of lymph nodes derived from patients with Hodgkin's disease.

Diabetes type I is considered to be a T-cell mediated autoimmune disease. The expression of CCR5 receptor in the pancreas was associated with the progression of type I diabetes in relevant animal models (Cameron (2000) J. Immunol. 165, 1102-1110). In particular, the CCR5 expression was associated with the development of insulinitis and spontaneous type I diabetes.

Several antibodies specifically binding to (human) CCR5 are known in the art and comprise, MC-1 (Mack (1998) J. Exp. Med. 187, 1215-1224 or MC-5 (Blanpain (2002) Mol Biol Cell. 13:723-37, Segerer (1999) Kidney Int. 56:52-64, Kraft (2001) Biol. Chem. 14; 276:34408-18). The CCR-5 antibodies, in particular MC-1 and MC-5 may serve as a source for Ig-derived second domain of the CD3 specific construct of the invention. Accordingly, in a preferred embodiment, the invention relates to a bispecific construct comprising at least two domains, wherein the first domain provides for the specificity to human CD3 and has a reduced propensity to generate T cell epitopes and whereby said Ig-derived second domain is derived from an antibody specific for (human) CCR5. Most preferably, such a construct is a single chain scFV as defined herein.

MC-1 was shown to bind specifically to the first part of the second extracellular loop of human CCR5 and did not cross-react with CCR5 derived from rhesus macaques as shown in the appended examples. Therefore, it is preferred that the CD3 specific construct of this invention comprises, for example, VL and VH domains of an antibody (i.e. an Ig-derived second domain) specific for CCR5, preferably the human CCR5, and VH and VL domains of an antibody specific for the CD3 antigen. Said antibody specific for the human CCR5 is the murine anti-human CCR5 antibody MC-1, described, inter alia, in Mack (1998), J. Exp. Med. 187, 1215-1224 and in the appended examples. Yet, it is envisaged that other anti-CCR5 antibodies, like MC-5 (as characterized in the appended examples and disclosed in Blanpain (2002) Mol Biol Cell. 13:723-37, Segerer (1999) Kidney Int. 56:52-64 and Kraft (2001) Biol. Chem. 14; 276: 34408-18 may be employed in the context of this invention.

In a particularly preferred embodiment of the present invention, CD3-specific binding constructs are provided, which comprise a deimmunized domain directed against/binding to/interacting with human CD3 and a second Ig-derived domain which specifically binds to/interacts with CCR5. Such constructs are shown in Table 6A and 6B. The modules A-G in Tables 6A and 6B can be defined as mentioned above for Tables 1-5. Deimmunized VH domains of antibodies having specificity for the human CD3 antigen can be selected from the sequences as set out in SEQ ID NOs.: 74 or 76. Deimmunized VL domains of antibodies having specificity for the human CD3 antigen can be selected from the sequences as set out in SEQ ID NOs.: 78, 80 or 82. The VH protein domain of human CCR5 antibody is as set out in SEQ ID NO.: 129. The VL protein domain of human CCR5 antibody is as set out in SEQ ID NO.: 131. When either the module pair A/C or E/G is a pair of deimmunized VH/VL or VL/VH protein domains from an antibody having specificity for the human CD3 antigen, protein module B or F, respectively, has the amino acid sequence as set out in SEQ ID NO.: 3. When either the module pair A/C or E/G is a pair of VH/VL or VL/VH from an antibody having specificity for the EpCAM antigen, protein module B or F, respectively, has the amino acid sequence as set out in SEQ ID NO.: 168. The respective groups of protein modules A-B-C and E-F-G are connected to each other through protein module D, having the sequence as set out in SEQ ID NO.: 174. However, as mentioned above an additional serine may be introduced for cloning purposes (linker as depicted in SEQ ID NO.:176) between the VL and subsequent V domain.

Nucleic acid molecules encoding deimmunized VH domains of antibodies having specificity for the human CD3 antigen can be selected from the sequences as set out in SEQ ID NOs.: 73 or 75. Nucleic acid molecules encoding deimmunized VL domains of antibodies having specificity for the human CD3 antigen can be selected from the sequences as set out in SEQ ID NOs.: 77, 79 or 81. The nucleic acid molecule encoding the VH protein domain of the human CCR5 antibody is as set out in SEQ ID NO.: 128. The nucleic acid molecule encoding the VL protein domain of the human CCR5 antibody is as set out in SEQ ID NO.: 130. When either the module pair NC or E/G denotes nucleic acid encoding a pair of deimmunized VH/VL or VL/VH protein domains from an antibody having specificity for the human CD3 antigen, nucleic acid module B or F, respectively, has the nucleic acid sequence as set out in SEQ ID NO.: 202. When either the module pair NC or E/G denotes nucleic acid enconding a pair of VH/VL or VL/VH from an antibody having specificity for the CCR5 antigen, nucleic acid module B or F, respectively, has the nucleic acid sequence as set out in SEQ ID NO.: 201. The groups of nucleic acid modules A-B-C and E-F-G are connected to each other through protein module D, having the sequence as set out in SEQ ID NO.: 173. An alternative linker SEQ ID NO.:175 may also be used to conjugate VL domain with a subsequent V domain (including an additional codon encoding a serine residue for cloning purposes).

TABLE 6A

Deimmunized anti-human CD3 constructs comprising single chain anti-CCR5 variable regions: amino acid sequence

| Construct | SEQ ID NO.: in construct portion . . . | | | | | | | deimmunized anti-CD3 construct/ Specificity (N -> C) | Domain Arrangement |
| | A | B | C | D | E | F | G | | |
| --- | --- | --- | --- | --- | --- | --- | --- | --- | --- |
| 1 | 80 | 3 | 74 | 174 | 129 | 168 | 131 | CD3 (VL2/VH5) × CCR5 | LHHL |
| 2 | 74 | 3 | 80 | 174 | 129 | 168 | 131 | CD3 (VH5/VL2) × CCR5 | HLHL |
| 3 | 80 | 3 | 74 | 174 | 131 | 168 | 129 | CD3 (VL2/VH5) × CCR5 | LHLH |
| 4 | 74 | 3 | 80 | 174 | 131 | 168 | 129 | CD3 (VH5/VL2) × CCR5 | HLLH |
| 5 | 131 | 168 | 129 | 174 | 74 | 3 | 80 | CCR5 × CD3 (VH5/VL2) | LHHL |
| 6 | 129 | 168 | 131 | 174 | 74 | 3 | 80 | CCR5 × CD3 (VH5/VL2) | HLHL |
| 7 | 131 | 168 | 129 | 174 | 80 | 3 | 74 | CCR5 × CD3 (VL2/VH5) | LHLH |
| 8 | 129 | 168 | 131 | 174 | 80 | 3 | 74 | CCR5 × CD3 (VL2/VH5) | HLLH |
| 9 | 80 | 3 | 76 | 174 | 129 | 168 | 131 | CD3 (VL2/VH7) × CCR5 | LHHL |
| 10 | 76 | 3 | 80 | 174 | 129 | 168 | 131 | CD3 (VH7/VL2) × CCR5 | HLHL |

TABLE 6A-continued

Deimmunized anti-human CD3 constructs comprising single chain anti-CCR5 variable regions: amino acid sequence

| Construct | SEQ ID NO.: in construct portion . . . | | | | | | | deimmunized anti-CD3 construct/ Specificity (N -> C) | Domain Arrangement |
|---|---|---|---|---|---|---|---|---|---|
| | A | B | C | D | E | F | G | | |
| 11 | 80 | 3 | 76 | 174 | 131 | 168 | 129 | CD3 (VL2/VH7) × CCR5 | LHLH |
| 12 | 76 | 3 | 80 | 174 | 131 | 168 | 129 | CD3 (VH7/VL2) × CCR5 | HLLH |
| 13 | 131 | 168 | 129 | 174 | 76 | 3 | 80 | CCR5 × CD3 (VH7/VL2) | LHHL |
| 14 | 129 | 168 | 131 | 174 | 76 | 3 | 80 | CCR5 × CD3 (VH7/VL2) | HLHL |
| 15 | 131 | 168 | 129 | 174 | 80 | 3 | 76 | CCR5 × CD3 (VL2/VH7) | LHLH |
| 16 | 129 | 168 | 131 | 174 | 80 | 3 | 76 | CCR5 × CD3 (VL2/VH7) | HLLH |

TABLE 6B

Deimmunized anti-human CD3 constructs comprising single chain anti-CCR5 variable regions: nucleic acid sequence

| Construct | SEQ ID NO.: in construct portion . . . | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 79 | 202 | 73 | 173 | 128 | 201 | 130 | CD3 (VL2/VH5) × CCR5 | LHHL |
| 2 | 73 | 202 | 79 | 173 | 128 | 201 | 130 | CD3 (VH5/VL2) × CCR5 | HLHL |
| 3 | 79 | 202 | 73 | 173 | 130 | 201 | 128 | CD3 (VL2/VH5) × CCR5 | LHLH |
| 4 | 73 | 202 | 79 | 173 | 130 | 201 | 128 | CD3 (VH5/VL2) × CCR5 | HLLH |
| 5 | 130 | 201 | 128 | 173 | 73 | 202 | 79 | CCR5 × CD3 (VH5/VL2) | LHHL |
| 6 | 128 | 201 | 130 | 173 | 73 | 202 | 79 | CCR5 × CD3 (VH5/VL2) | HLHL |
| 7 | 130 | 201 | 128 | 173 | 79 | 202 | 73 | CCR5 × CD3 (VL2/VH5) | LHLH |
| 8 | 128 | 201 | 130 | 173 | 79 | 202 | 73 | CCR5 × CD3 (VL2/VH5) | HLLH |
| 9 | 79 | 202 | 75 | 173 | 128 | 201 | 130 | CD3 (VL2/VH7) × CCR5 | LHHL |
| 10 | 75 | 202 | 79 | 173 | 128 | 201 | 130 | CD3 (VH7/VL2) × CCR5 | HLHL |
| 11 | 79 | 202 | 75 | 173 | 130 | 201 | 128 | CD3 (VL2/VH7) × CCR5 | LHLH |
| 12 | 75 | 202 | 79 | 173 | 130 | 201 | 128 | CD3 (VH7/VL2) × CCR5 | HLLH |
| 13 | 130 | 201 | 128 | 173 | 75 | 202 | 79 | CCR5 × CD3 (VH7/VL2) | LHHL |
| 14 | 128 | 201 | 130 | 173 | 75 | 202 | 79 | CCR5 × CD3 (VH7/VL2) | HLHL |
| 15 | 130 | 201 | 128 | 173 | 79 | 202 | 75 | CCR5 × CD3 (VL2/VH7) | LHLH |
| 16 | 128 | 201 | 130 | 173 | 79 | 202 | 75 | CCR5 × CD3 (VL2/VH7) | HLLH |

Preferably, said constructs comprise an amino acid sequence selected from the group of
(a) an amino acid sequence as shown in any one of SEQ ID NO.: 206, 208, 210, 212, 214 or 216;
(b) an amino acid sequence encoded by a nucleic acid sequence as shown in any one of in SEQ ID NO.: 205, 207, 209, 211, 213 or 215; and
(c) an amino acid sequence encoded by a nucleic acid sequence which is degenerate as a result of the genetic code to a nucleotide sequence of (b);
(d) and amino acid sequence encoded by a nucleic acid sequence hybridising with the complementary strand of a nucleic acid sequence as defined in (b) under stringent hybridisation conditions.

The CCR5 and CD3 binding constructs SEQ ID NO.:206, 208, 210 represent construct 5 and SEQ ID NO.:212, 214 and 216 represent construct 13 of Table 6 and have the three different VL regions (VL1 (SEQ ID NO.:78), VL2 (SEQ ID NO.:80), or VL3 (SEQ ID NO.:82).

The present invention also provides for CD3 specific binding constructs comprising a first domain which specifically binds to human CD3 and has reduced propensity to generate T cell epitopes and comprising an Ig-derived second domain directed against/capable of binding to CCR5, which comprise an amino acid sequence encoded by a nucleic acid sequence hybridizing with the complementary strand of a nucleic acid sequence as defined in (b) herein above, i.e. to a nucleic acid sequence as shown in any one of SEQ ID NO.: 205, 207, 209, 211, 213 or 215 under stringent hybridization conditions. The terms "hybridization" and "stringent conditions" have been described herein above. The corresponding definitions and embodiments apply here mutatis mutandis.

The deimmunized CD3 and CCR5 binding constructs provided herein are particularly useful in the medical intervention of viral disease, in particular HIV infections and AIDS, or of autoimmune diseases and/or inflammatory diseases, like rheumatoid arthritis.

In another embodiment, the present invention provides for CD3 specific binding constructs as defined herein above, wherein the Ig-derived second domain of the inventive construct comprises an antigen-interaction site with specificity for CD19.

CD19 has proved to be a very useful medical target. CD19 is expressed in the whole B cell lineage from the pro B cell to the mature B cell, it is not shed, is uniformly expressed on all lymphoma cells, and is absent from stem cells (Haagen, Clin Exp Immunol 90 (1992), 368-75; Uckun, Proc. Natl. Acad. Sci. USA 85 (1988), 8603-7). Combination therapy employing both an antibody directed against CD19 and an additional immunoregulatory antibody has been disclosed for the treatment of B cell malignancies (WO 02/04021, US2002006404, US2002028178) and autoimmune diseases (WO 02/22212, US2002058029). WO 00/67795 discloses the use i.a. of antibodies directed against CD19 for the treatment of indolent and aggressive forms of B-cell lymphomas, as well as acute and chronic forms of lymphatic leukemias. WO 02/80987 discloses the therapeutic use of immunotoxins based on antibodies against the antigen CD19 for the treatment of such diseases as B cell non-Hodgkin's lymphoma, Hodgkin's lymphoma or B cell leukemias (e.g. B cell acute lymphatic leukemia (B-ALL), (e.g. hairy cell lymphoma) B cell precursor acute lymphatic leukemia (pre-B-ALL), B cell chronic lymphatic leukemia (B-CLL)).

In a particularly preferred embodiment of the present invention, CD3-specific binding constructs are provided, which comprise an deimmunized domain directed against/binding to/interacting with human CD3 and a second Ig-derived domain which specifically binds to/interacts with CD19. Such constructs are shown in Tables 7A and 7B. The modules A-G in Tables 7A and 7B can be defined as mentioned above for Tables 1-5. Deimmunized VH domains of antibodies having specificity for the human CD3 antigen can be selected from the sequences as set out in SEQ ID NOs.: 74 or 76. Deimmunized VL domains of antibodies having specificity for the human CD3 antigen can be selected from the sequences as set out in SEQ ID NOs.: 78, 80 or 82. The VH protein domain of human CD19 antibody is as set out in SEQ ID NO.: 114. The VL protein domain of human CCR5 antibody is as set out in SEQ ID NO.: 116. When either the module pair NC or E/G is a pair of deimmunized VHNL or VL/VH protein domains from an antibody having specificity for the human CD3 antigen, protein module B or F, respectively, has the amino acid sequence as set out in SEQ ID NO.: 3. When either the module pair NC or E/G is a pair of VHNL or VL/VH from an antibody having specificity for the CD19 antigen, protein module B or F, respectively, has the amino acid sequence as set out in SEQ ID NO.: 168. The respective groups of protein modules A-B-C and E-F-G are connected to each other through protein module D, having the sequence as set out in SEQ ID NO.: 174. However, as mentioned above an additional serine may be introduced for cloning purposes (linker as depicted in SEQ ID NO.:176) between the VL and subsequent V domain.

Nucleic acid molecules encoding deimmunized VH domains of antibodies having specificity for the human CD3 antigen can be selected from the sequences as set out in SEQ ID NOs.: 73 or 75. Nucleic acid molecules encoding deimmunized VL domains of antibodies having specificity for the human CD3 antigen can be selected from the sequences as set out in SEQ ID NOs.: 77, 79 or 81. The nucleic acid molecule encoding the VH protein domain of the human CD19 antibody is as set out in SEQ ID NO.: 113. The nucleic acid molecule encoding the VL protein domain of the human CCR5 antibody is as set out in SEQ ID NO.: 115. When either the module pair A/C or E/G denotes nucleic acid encoding a pair of deimmunized VHNL or VL/VH protein domains from an antibody having specificity for the human CD3 antigen, nucleic acid module B or F, respectively, has the amino acid sequence as set out in SEQ ID NO.: 202. When either the module pair A/C or E/G denotes a nucleic acid encoding a pair of VHNL or VL/VH from an antibody having specificity for the CD19 antigen, nucleic acid module B or F, respectively, has the nucleic acid sequence as set out in SEQ ID NO.: 201. The groups of nucleic acid modules A-B-C and E-F-G are connected to each other through protein module D, having the sequence as set out in SEQ ID NO.: 173. An alternative linker SEQ ID NO.:175 may also be used to conjugate VL domain with a subsequent V domain (including an additional codon encoding a serine residue for cloning purposes).

TABLE 7A

Deimmunized anti-human CD3 constructs comprising single chain anti-CD19 variable regions: amino acid sequence

| Construct | SEQ ID NO.: in construct portion . . . | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 80 | 3 | 74 | 174 | 114 | 168 | 116 | CD3 (VL2/VH5) × CD19 | LHHL |
| 2 | 74 | 3 | 80 | 174 | 114 | 168 | 116 | CD3 (VH5/VL2) × CD19 | HLHL |
| 3 | 80 | 3 | 74 | 174 | 116 | 168 | 114 | CD3 (VL2/VH5) × CD19 | LHLH |
| 4 | 74 | 3 | 80 | 174 | 116 | 168 | 114 | CD3 (VH5/VL2) × CD19 | HLLH |
| 5 | 116 | 168 | 114 | 174 | 74 | 3 | 80 | CD19 × CD3 (VH5/VL2) | LHHL |
| 6 | 114 | 168 | 116 | 174 | 74 | 3 | 80 | CD19 × CD3 (VH5/VL2) | HLHL |
| 7 | 116 | 168 | 114 | 174 | 80 | 3 | 74 | CD19 × CD3 (VL2/VH5) | LHLH |
| 8 | 114 | 168 | 116 | 174 | 80 | 3 | 74 | CD19 × CD3 (VL2/VH5) | HLLH |
| 9 | 80 | 3 | 76 | 174 | 114 | 168 | 116 | CD3 (VL2/VH7) × CD19 | LHHL |
| 10 | 76 | 3 | 80 | 174 | 114 | 168 | 116 | CD3 (VH7/VL2) × CD19 | HLHL |
| 11 | 80 | 3 | 76 | 174 | 116 | 168 | 114 | CD3 (VL2/VH7) × CD19 | LHLH |
| 12 | 76 | 3 | 80 | 174 | 116 | 168 | 114 | CD3 (VH7/VL2) × CD19 | HLLH |
| 13 | 116 | 168 | 114 | 174 | 76 | 3 | 80 | CD19 × CD3 (VH7/VL2) | LHHL |
| 14 | 114 | 168 | 116 | 174 | 76 | 3 | 80 | CD19 × CD3 (VH7/VL2) | HLHL |
| 15 | 116 | 168 | 114 | 174 | 80 | 3 | 76 | CD19 × CD3 (VL2/VH7) | LHLH |
| 16 | 114 | 168 | 116 | 174 | 80 | 3 | 76 | CD19 × CD3 (VL2/VH7) | HLLH |

TABLE 7B

Deimmunized anti-human CD3 constructs comprising single chain anti-CD19 variable regions: Nucleic acid sequence

| Construct | SEQ ID NO.: in construct portion ... | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 79 | 202 | 73 | 173 | 113 | 201 | 115 | CD3 (VL2/VH5) × CD19 | LHHL |
| 2 | 73 | 202 | 79 | 173 | 113 | 201 | 115 | CD3 (VH5/VL2) × CD19 | HLHL |
| 3 | 79 | 202 | 73 | 173 | 115 | 201 | 113 | CD3 (VL2/VH5) × CD19 | LHLH |
| 4 | 73 | 202 | 79 | 173 | 115 | 201 | 113 | CD3 (VH5/VL2) × CD19 | HLLH |
| 5 | 115 | 201 | 113 | 173 | 73 | 202 | 79 | CD19 × CD3 (VH5/VL2) | LHHL |

TABLE 7B-continued

Deimmunized anti-human CD3 constructs comprising single chain anti-CD19 variable regions: Nucleic acid sequence

| Construct | SEQ ID NO.: in construct portion ... | | | | | | | deimmunized anti-CD3 construct/ Specificity (N -> C) | Domain Arrangement |
|---|---|---|---|---|---|---|---|---|---|
| | A | B | C | D | E | F | G | | |
| 6 | 113 | 201 | 115 | 173 | 73 | 202 | 79 | CD19 × CD3 (VH5/VL2) | HLHL |
| 7 | 115 | 201 | 113 | 173 | 79 | 202 | 73 | CD19 × CD3 (VL2/VH5) | LHLH |
| 8 | 113 | 201 | 115 | 173 | 79 | 202 | 73 | CD19 × CD3 (VL2/VH5) | HLLH |
| 9 | 79 | 202 | 75 | 173 | 113 | 201 | 115 | CD3 (VL2/VH7) × CD19 | LHHL |
| 10 | 75 | 202 | 79 | 173 | 113 | 201 | 115 | CD3 (VH7/VL2) × CD19 | HLHL |
| 11 | 79 | 202 | 75 | 173 | 115 | 201 | 113 | CD3 (VL2/VH7) × CD19 | LHLH |
| 12 | 75 | 202 | 79 | 173 | 115 | 201 | 113 | CD3 (VH7/VL2) × CD19 | HLLH |
| 13 | 115 | 201 | 113 | 173 | 75 | 202 | 79 | CD19 × CD3 (VH7/VL2) | LHHL |
| 14 | 113 | 201 | 115 | 173 | 75 | 202 | 79 | CD19 × CD3 (VH7/VL2) | HLHL |
| 15 | 115 | 201 | 113 | 173 | 79 | 202 | 75 | CD19 × CD3 (VL2/VH7) | LHLH |
| 16 | 113 | 201 | 115 | 173 | 79 | 202 | 75 | CD19 × CD3 (VL2/VH7) | HLLH |

In a more preferred embodiment, the present invention provides for a deimmunized CD3-specific binding construct which comprises a CD3-binding domain as defined above and a second, Ig-derived domain which specifically binds to/interacts with CD19, preferably human CD19, wherein said CD3-specific binding construct comprises an amino acid sequence selected from the group of (a) an amino acid sequence as shown in any one of SEQ ID NO.: 190, 192, 194, 196, 198, 200, 327, 329, 331, 333, 335, 337, 339, 341, 343, 345, 347, 349, 351, 353, 357, 359, 361, 363, 365, 367, 369, 371, 373, 375, 377, 379, 381, 383, 385, 387, 389, 391, 393, 395, 397, 399, 401, 403, 405, 407 or 409;

(b) an amino acid sequence encoded by a nucleic acid sequence as shown in any one of in SEQ ID NO.: 189, 191, 193, 195, 197, 199, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406 or 408; and (c) an amino acid sequence encoded by a nucleic acid sequence which is degenerate as a result of the genetic code to a nucleotide sequence of (b);

(d) and amino acid sequence encoded by a nucleic acid sequence hybridising with the complementary strand of a nucleic acid sequence as defined in (b) under stringent hybridisation conditions.

Preferred CD19 and CD3 binding constructs according to the invention are SEQ ID NO.:190, 192, 194 representing construct 5 and SEQ ID NO.:196, 198 and 200 representing construct 13 of Table 7 and having the three different VL regions (VL1 (SEQ ID NO.:78), VL2 (SEQ ID NO.:80), or VL3 (SEQ ID NO.:82)).

The present invention also provides for CD3 specific binding constructs comprising a first domain which specifically binds to human CD3 and has reduced propensity to generate T cell epitopes and comprising an Ig-derived second domain directed against/capable of binding to CD19, which comprise an amino acid sequence encoded by a nucleic acid sequence hybridizing with the complementary strand of a nucleic acid sequence as defined in (b) herein above, i.e. to a nucleic acid sequence as shown in any one of SEQ ID NOs.: 189, 191, 193, 195, 197, 199, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406 or 408, under stringent hybridization conditions. The terms "hybridization" and "stringent conditions" have been described herein above. The corresponding definitions and embodiments apply here mutatis mutandis.

The herein disclosed deimmunized CD3 and CD19 binding constructs are particularly useful in the prevention, treatment or amelioration of a proliferative disease, a tumorous disease, an inflammatory disease, an immunological disorder, an autoimmune disease, an infectious disease, a viral disease, allergic reactions, parasitic reactions, graft-versus-hosseases, host-versus-graft diseases or B-cell malignancies, in particular B cell non-Hodgkin's lymphoma, Hodgkin's lymphoma or B cell leukemias (e.g. B cell acute lymphoatic leukemia (B-ALL), (e.g. hairy cell lymphoma) B cell precursor acute lymphatic leukemia (pre-B-ALL), B cell chronic lymphatic leukemia (B-CLL)) leukemia.

In a further embodiment, the present invention relates to a CD3 specific binding construct as defined above comprising a first domain specifically binding to human CD3 and having reduced propensity to generate T cell epitopes and a second domain, wherein said second domain is Ig-derived and comprises an antigen-interaction site with a specificity for CD20.

CD20 is one of the cell surface proteins present on B-lymphocytes. CD20 antigen is found in normal and malignant pre-B and mature B lymphocytes, including those in over 90% of B-cell non-Hodgkin's lymphomas (NHL). The antigen is absent in hematopoetic stem cells, activated B lymphocytes (plasma cells) and normal tissue. Several antibodies mostly of murine origin have been described: 1F5 (Press et al., 1987, Blood 69/2, 584-591), 2B8/C2B8, 2H7, 1H4 (Liu et al., 1987, J Immunol 139, 3521-3526; Anderson et al., 1998, U.S. Pat. No. 5,736,137; Haisma et al., 1998, Blood 92, 184-190; Shan et al., 1999, J. Immunol. 162, 6589-6595).

CD20 has been described in immunotherapeutic strategies for the treatment of plasma cell malignancies using vaccination with DNA encoding scFv linked to carrier protein (Treon et al., 2000, Semin Oncol 27(5), 598) and in immunotherapeutic treatment using CD20 antibodies (IDEC-C2B8) have been shown to be effective in the treatment of non-Hodgkin's B-cell lymphoma. CD20 antibodies have proven efficacy and tolerability in non-Hodgkin's lymphoma, achieving response rates of 73% and 48% in previously untreated or relapsed/refractory indolent non-Hodgkin's lymphoma, respectively (Montserrat, 2003, Semin Oncol 30(1suppl2), 34-39). Furthermore, CD20 antibodies have been widely used to treat relapsing or advanced stage B-cell neoplasms with an efficacy of about 50%.

In a particularly preferred embodiment of the present invention, CD3-specific binding constructs are provided, which comprise a deimmunized domain directed against/ binding to/interacting with human CD3 and a second Ig-derived domain which specifically binds to/interacts with CD20. Such constructs are shown in Tables 8A and 8B. The modules A-G in Tables 8A and 8B can be defined as mentioned above for Tables 1-5. Deimmunized VH domains of antibodies having specificity for the human CD3 antigen can be selected from the sequences as set out in SEQ ID NOs.: 74 or 76. Deimmunized VL domains of antibodies having specificity for the human CD3 antigen can be selected from the sequences as set out in SEQ ID NOs.: 78, 80 or 82. The VH protein domain of human CD20 antibody is as set out in SEQ ID NO.: 170. The VL protein domain of human CD20 antibody is as set out in SEQ ID NO.: 172. When either the module pair NC or E/G is a pair of deimmunized VHNL or VL/VH protein domains from an antibody having specificity for the human CD3 antigen, protein module B or F, respectively, has the amino acid sequence as set out in SEQ ID NO.: 3. When either the module pair A/C or E/G is a pair of VHNL or VL/VH from an antibody having specificity for the CD20 antigen, protein module B or F, respectively, has the amino acid sequence as set out in SEQ ID NO.: 168. The respective groups of protein modules A-B-C and E-F-G are connected to each other through protein module D, having the sequence as set out in SEQ ID NO.: 174. However, as mentioned above an additional serine may be introduced for cloning purposes (linker as depicted in SEQ ID NO.:176) between the VL and subsequent V domain.

Nucleic acid molecules encoding deimmunized VH domains of antibodies having specificity for the human CD3 antigen can be selected from the sequences as set out in SEQ ID NOs.: 73 or 75. Nucleic acid molecules encoding deimmunized VL domains of antibodies having specificity for the human CD3 antigen can be selected from the sequences as set out in SEQ ID NOs.: 77, 79 or 81. The nucleic acid molecule encoding the VH protein domain of the human CD20 antibody is as set out in SEQ ID NO.: 169. The nucleic acid molecule encoding the VL protein domain of the human CD20 antibody is as set out in SEQ ID NO.: 171. When either the module pair NC or E/G denotes a nucleic acid encoding a pair of deimmunized VHNL or VL/VH protein domains from an antibody having specificity for the human CD3 antigen, nucleic acid module B or F, respectively, has the amino acid sequence as set out in SEQ ID NO.: 202. When either the module pair NC or E/G denotes a nucleic acid encoding a pair of VHNL or VL/VH from an antibody having specificity for the CD20 antigen, nucleic acid module B or F, respectively, has the nucleic acid sequence as set out in SEQ ID NO.: 201. The groups of nucleic acid modules A-B-C and E-F-G are connected to each other through nucleic acid module D, having the sequence as set out in SEQ ID NO.: 173. An alternative linker SEQ ID NO.:175 may also be used to conjugate VL domain with a subsequent V domain (including an additional codon encoding a serine residue for cloning purposes).

TABLE 8A

Deimmunized anti-human CD3 constructs comprising single chain anti-CD20 variable regions: amino acid sequence

| Construct | SEQ ID NO.: in construct portion . . . | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 80 | 3 | 74 | 174 | 170 | 168 | 172 | CD3 (VL2/VH5) x CD20 | LHHL |
| 2 | 74 | 3 | 80 | 174 | 170 | 168 | 172 | CD3 (VH5/VL2) x CD20 | HLHL |
| 3 | 80 | 3 | 74 | 174 | 172 | 168 | 170 | CD3 (VL2/VH5) x CD20 | LHLH |
| 4 | 74 | 3 | 80 | 174 | 172 | 168 | 170 | CD3 (VH5/VL2) x CD20 | HLLH |
| 5 | 172 | 168 | 170 | 174 | 74 | 3 | 80 | CD20 x CD3 (VH5/VL2) | LHHL |
| 6 | 170 | 168 | 172 | 174 | 74 | 3 | 80 | CD20 x CD3 (VH5/VL2) | HLHL |
| 7 | 172 | 168 | 170 | 174 | 80 | 3 | 74 | CD20 x CD3 (VL2/VH5) | LHLH |
| 8 | 170 | 168 | 172 | 174 | 80 | 3 | 74 | CD20 x CD3 (VL2/VH5) | HLLH |
| 9 | 80 | 3 | 76 | 174 | 170 | 168 | 172 | CD3 (VL2/VH7) x CD20 | LHHL |
| 10 | 76 | 3 | 80 | 174 | 170 | 168 | 172 | CD3 (VH7/VL2) x CD20 | HLHL |
| 11 | 80 | 3 | 76 | 174 | 172 | 168 | 170 | CD3 (VL2/VH7) x CD20 | LHLH |
| 12 | 76 | 3 | 80 | 174 | 172 | 168 | 170 | CD3 (VH7/VL2) x CD20 | HLLH |
| 13 | 172 | 168 | 170 | 174 | 76 | 3 | 80 | CD20 x CD3 (VH7/VL2) | LHHL |
| 14 | 170 | 168 | 172 | 174 | 76 | 3 | 80 | CD20 x CD3 (VH7/VL2) | HLHL |
| 15 | 172 | 168 | 170 | 174 | 80 | 3 | 76 | CD20 x CD3 (VL2/VH7) | LHLH |
| 16 | 170 | 168 | 172 | 174 | 80 | 3 | 76 | CD20 x CD3 (VL2/VH7) | HLLH |

TABLE 8B

Deimmunized anti-human CD3 constructs comprising single chain anti-CD20 variable regions: Nucleotide sequence

| Construct | SEQ ID NO.: in construct portion ... | | | | | | | deimmunized anti-CD3 construct/ Specificity (N -> C) | Domain Arrangement |
|---|---|---|---|---|---|---|---|---|---|
| | A | B | C | D | E | F | G | | |
| 1 | 79 | 202 | 73 | 173 | 169 | 201 | 171 | CD3 (VL2/VH5) x CD20 | LHHL |
| 2 | 73 | 202 | 79 | 173 | 169 | 201 | 171 | CD3 (VH5/VL2) x CD20 | HLHL |
| 3 | 79 | 202 | 73 | 173 | 171 | 201 | 169 | CD3 (VL2/VH5) x CD20 | LHLH |
| 4 | 73 | 202 | 79 | 173 | 171 | 201 | 169 | CD3 (VH5/VL2) x CD20 | HLLH |
| 5 | 171 | 201 | 169 | 173 | 73 | 202 | 79 | CD20 x CD3 (VH5/VL2) | LHHL |
| 6 | 169 | 201 | 171 | 173 | 73 | 202 | 79 | CD20 x CD3 (VH5/VL2) | HLHL |
| 7 | 171 | 201 | 169 | 173 | 79 | 202 | 73 | CD20 x CD3 (VL2/VH5) | LHLH |
| 8 | 169 | 201 | 171 | 173 | 79 | 202 | 73 | CD20 x CD3 (VL2/VH5) | HLLH |
| 9 | 79 | 202 | 75 | 173 | 169 | 201 | 171 | CD3 (VL2/VH7) x CD20 | LHHL |
| 10 | 75 | 202 | 79 | 173 | 169 | 201 | 171 | CD3 (VH7/VL2) x CD20 | HLHL |
| 11 | 79 | 202 | 75 | 173 | 171 | 201 | 169 | CD3 (VL2/VH7) x CD20 | LHLH |

TABLE 8B-continued

Deimmunized anti-human CD3 constructs comprising single chain anti-CD20 variable regions: Nucleotide sequence

| Construct | SEQ ID NO.: in construct portion ... | | | | | | | deimmunized anti-CD3 construct/ Specificity (N -> C) | Domain Arrangement |
| --- | --- | --- | --- | --- | --- | --- | --- | --- | --- |
| | A | B | C | D | E | F | G | | |
| 12 | 75 | 202 | 79 | 173 | 171 | 201 | 169 | CD3 (VH7/VL2) × CD20 | HLLH |
| 13 | 171 | 201 | 169 | 173 | 75 | 202 | 79 | CD20 × CD3 (VH7/VL2) | LHHL |
| 14 | 169 | 201 | 171 | 173 | 75 | 202 | 79 | CD20 × CD3 (VH7/VL2) | HLHL |
| 15 | 171 | 201 | 169 | 173 | 79 | 202 | 75 | CD20 × CD3 (VL2/VH7) | LHLH |
| 16 | 169 | 201 | 171 | 173 | 79 | 202 | 75 | CD20 × CD3 (VL2/VH7) | HLLH |

More preferably, the deimmunized CD3 and CD20 binding constructs of the present invention comprises an amino acid sequence which is selected from the group consisting of
(a) an amino acid sequence as shown in any one of SEQ ID NO.: 218, 220, 222, 224, 226, or 228;
(b) an amino acid sequence encoded by a nucleic acid sequence as shown in any one of in SEQ ID NO.: 217, 219, 221, 223, 225 or 227; and
(c) an amino acid sequence encoded by a nucleic acid sequence which is degenerate as a result of the genetic code to a nucleotide sequence of (b);
(d) and amino acid sequence encoded by a nucleic acid sequence hybridizing with the complementary strand of a nucleic acid sequence as defined in (b) under stringent hybridization conditions.

The present invention also provides for CD3 specific binding constructs comprising a first domain which specifically binds to human CD3 and has reduced propensity to generate T cell epitopes and comprising an Ig-derived second domain directed against/capable of binding to CD20, which comprise an amino acid sequence encoded by a nucleic acid sequence hybridizing with the complementary strand of a nucleic acid sequence as defined in (b) herein above, i.e. to a nucleic acid sequence as shown in any one of SEQ ID NO.: 217, 219, 221, 223, 225 or 227, under stringent hybridization conditions. The terms "hybridization" and "stringent conditions" have been described herein above. The corresponding definitions and embodiments apply here mutatis mutandis.

The herein described deimmunized CD3 and CD20 binding constructs are envisaged for use in the treatment, prevention and/or amelioration of B-cell related disorders, preferably in the medical intervention of lymphoma, more preferably in the treatment of non-Hodgkin lymphoma.

The invention also provides for nucleic acid sequence encoding a CD3 specific binding molecule of the invention.

It is evident to the person skilled in the art that regulatory sequences may be added to the nucleic acid molecule of the invention. For example, promoters, transcriptional enhancers and/or sequences which allow for induced expression of the polynucleotide of the invention may be employed. A suitable inducible system is for example tetracycline-regulated gene expression as described, e.g., by Gossen and Bujard (Proc. Natl. Acad. Sci. USA 89 (1992), 5547-5551) and Gossen et al. (Trends Biotech. 12 (1994), 58-62), or a dexamethasone-inducible gene expression system as described, e.g. by Crook (1989) EMBO J. 8, 513-519.

Furthermore, it is envisaged for further purposes that nucleic acid molecules may contain, for example, thioester bonds and/or nucleotide analogues. Said modifications may be useful for the stabilization of the nucleic acid molecule against endo- and/or exonucleases in the cell. Said nucleic acid molecules may be transcribed by an appropriate vector containing a chimeric gene which allows for the transcription of said nucleic acid molecule in the cell. In this respect, it is also to be understood that such polynucleotide can be used for "gene targeting" or "gene therapeutic" approaches. In another embodiment said nucleic acid molecules are labeled. Methods for the detection of nucleic acids are well known in the art, e.g., Southern and Northern blotting, PCR or primer extension. This embodiment may be useful for screening methods for verifying successful introduction of the nucleic acid molecules described above during gene therapy approaches.

Said nucleic acid molecule(s) may be a recombinantly produced chimeric nucleic acid molecule comprising any of the aforementioned nucleic acid molecules either alone or in combination. Preferably, the nucleic acid molecule is part of a vector.

The present invention therefore also relates to a vector comprising the nucleic acid molecule described in the present invention.

Many suitable vectors are known to those skilled in molecular biology, the choice of which would depend on the function desired and include plasmids, cosmids, viruses, bacteriophages and other vectors used conventionally in genetic engineering. Methods which are well known to those skilled in the art can be used to construct various plasmids and vectors; see, for example, the techniques described in Sambrook et al. (loc. cit.) and Ausubel, Current Protocols in Molecular Biology, Green Publishing Associates and Wiley Interscience, N.Y. (1989), (1994). Alternatively, the polynucleotides and vectors of the invention can be reconstituted into liposomes for delivery to target cells. As discussed in further details below, a cloning vector was used to isolate individual sequences of DNA. Relevant sequences can be transferred into expression vectors where expression of a particular polypeptide is required. Typical cloning vectors include pBluescript SK, pGEM, pUC9, pBR322 and pGBT9. Typical expression vectors include pTRE, pCAL-n-EK, pESP-1, pOP13CAT.

Preferably said vector comprises a nucleic acid sequence which is a regulatory sequence operably linked to said nucleic acid sequence encoding a bispecific single chain antibody constructs defined herein.

Such regulatory sequences (control elements) are known to the artisan and may include a promoter, a splice cassette, translation initiation codon, translation and insertion site for introducing an insert into the vector. Preferably, said nucleic acid molecule is operatively linked to said expression control sequences allowing expression in eukaryotic or prokaryotic cells.

It is envisaged that said vector is an expression vector comprising the nucleic acid molecule encoding a bispecific single chain antibody constructs defined herein.

The term "regulatory sequence" refers to DNA sequences, which are necessary to effect the expression of coding sequences to which they are ligated. The nature of such control sequences differs depending upon the host organism. In prokaryotes, control sequences generally include promoter, ribosomal binding site, and terminators. In eukaryotes generally control sequences include promoters, terminators and, in some instances, enhancers, transactivators or transcription factors. The term "control sequence" is intended to include, at a minimum, all components the presence of which are necessary for expression, and may also include additional advantageous components.

The term "operably linked" refers to a juxtaposition wherein the components so described are in a relationship permitting them to function in their intended manner. A control sequence "operably linked" to a coding sequence is ligated in such a way that expression of the coding sequence is achieved under conditions compatible with the control sequences. In case the control sequence is a promoter, it is obvious for a skilled person that double-stranded nucleic acid is preferably used.

Thus, the recited vector is preferably an expression vector. An "expression vector" is a construct that can be used to transform a selected host and provides for expression of a coding sequence in the selected host. Expression vectors can for instance be cloning vectors, binary vectors or integrating vectors. Expression comprises transcription of the nucleic acid molecule preferably into a translatable mRNA. Regulatory elements ensuring expression in prokaryotes and/or eukaryotic cells are well known to those skilled in the art. In the case of eukaryotic cells they comprise normally promoters ensuring initiation of transcription and optionally poly-A signals ensuring termination of transcription and stabilization of the transcript. Possible regulatory elements permitting expression in prokaryotic host cells comprise, e.g., the $P_L$, lac, trp or tac promoter in *E. coli*, and examples of regulatory elements permitting expression in eukaryotic host cells are the AOX1 or GAL1 promoter in yeast or the CMV-, SV40-, RSV-promoter (Rous sarcoma virus), CMV-enhancer, SV40-enhancer or a globin intron in mammalian and other animal cells.

Beside elements which are responsible for the initiation of transcription such regulatory elements may also comprise transcription termination signals, such as the SV40-poly-A site or the tk-poly-A site, downstream of the polynucleotide. Furthermore, depending on the expression system used leader sequences capable of directing the polypeptide to a cellular compartment or secreting it into the medium may be added to the coding sequence of the recited nucleic acid sequence and are well known in the art; see also, e.g., appended example 1. The leader sequence(s) is (are) assembled in appropriate phase with translation, initiation and termination sequences, and preferably, a leader sequence capable of directing secretion of translated protein, or a portion thereof, into the periplasmic space or extracellular medium. Optionally, the heterologous sequence can encode a fusion protein including an N-terminal identification peptide imparting desired characteristics, e.g., stabilization or simplified purification of expressed recombinant product; see supra. In this context, suitable expression vectors are known in the art such as Okayama-Berg cDNA expression vector pcDV1 (Pharmacia), pCDM8, pRc/CMV, pcDNA1, pcDNA3 (In-vitrogene), pEF-DHFR, pEF-ADA or pEF-neo (Raum et al. Cancer Immunol Immunother (2001) 50(3), 141-150) or pSPORT1 (GIBCO BRL).

Preferably, the expression control sequences will be eukaryotic promoter systems in vectors capable of transforming of transfecting eukaryotic host cells, but control sequences for prokaryotic hosts may also be used. Once the vector has been incorporated into the appropriate host, the host is maintained under conditions suitable for high level expression of the nucleotide sequences, and as desired, the collection and purification of the polypeptide of the invention may follow; see, e.g., the appended examples.

An alternative expression system which could be used is an insect system. In one such system, *Autographa californica* nuclear polyhedrosis virus (AcNPV) is used as a vector to express foreign genes in *Spodoptera frugiperda* cells or in *Trichoplusia larvae*. The coding sequence of a recited nucleic acid molecule may be cloned into a nonessential region of the virus, such as the polyhedrin gene, and placed under control of the polyhedrin promoter. Successful insertion of said coding sequence will render the polyhedrin gene inactive and produce recombinant virus lacking coat protein coat. The recombinant viruses are then used to infect *S. frugiperda* cells or *Trichoplusia larvae* in which the protein of the invention is expressed (Smith, J. Virol. 46 (1983), 584; Engelhard, Proc. Nat. Acad. Sci. USA 91 (1994), 3224-3227). Additional regulatory elements may include transcriptional as well as translational enhancers. Advantageously, the above-described vectors of the invention comprises a selectable and/or scorable marker.

Selectable marker genes useful for the selection of transformed cells and, e.g., plant tissue and plants are well known to those skilled in the art and comprise, for example, antimetabolite resistance as the basis of selection for dhfr, which confers resistance to methotrexate (Reiss, Plant Physiol. (Life Sci. Adv.) 13 (1994), 143-149); npt, which confers resistance to the aminoglycosides neomycin, kanamycin and paromycin (Herrera-Estrella, EMBO J. 2 (1983), 987-995) and hygro, which confers resistance to hygromycin (Marsh, Gene 32 (1984), 481-485). Additional selectable genes have been described, namely trpB, which allows cells to utilize indole in place of tryptophan; hisD, which allows cells to utilize histinol in place of histidine (Hartman, Proc. Natl. Acad. Sci. USA 85 (1988), 8047); mannose-6-phosphate isomerase which allows cells to utilize mannose (WO 94/20627) and ODC (ornithine decarboxylase) which confers resistance to the ornithine decarboxylase inhibitor, 2-(difluoromethyl)-DL-ornithine, DFMO (McConlogue, 1987, In: Current Communications in Molecular Biology, Cold Spring Harbor Laboratory ed.) or deaminase from *Aspergillus terreus* which confers resistance to Blasticidin S (Tamura, Biosci. Biotechnol. Biochem. 59 (1995), 2336-2338).

Useful scorable markers are also known to those skilled in the art and are commercially available. Advantageously, said marker is a gene encoding luciferase (Giacomin, Pl. Sci. 116 (1996), 59-72; Scikantha, J. Bact. 178 (1996), 121), green fluorescent protein (Gerdes, FEBS Lett. 389 (1996), 44-47) or β-glucuronidase (Jefferson, EMBO J. 6 (1987), 3901-3907). This embodiment is particularly useful for simple and rapid screening of cells, tissues and organisms containing a recited vector.

As described above, the recited nucleic acid molecule can be used alone or as part of a vector to express the encoded CD3 specific construct in cells, for, e.g., purification but also for gene therapy purposes. The nucleic acid molecules or vectors containing the DNA sequence(s) encoding any one of the above described (bispecific) CD3 constructs is introduced into the cells which in turn produce the polypeptide of interest. Gene therapy, which is based on introducing therapeutic genes into cells by ex-vivo or in-vivo techniques is one of the most important applications of gene transfer. Suitable vectors, methods or gene-delivery systems for in-vitro or in-vivo gene therapy are described in the literature and are known to the person skilled in the art; see, e.g., Giordano, Nature Medicine 2 (1996), 534-539; Schaper, Circ. Res. 79 (1996), 911-

919; Anderson, Science 256 (1992), 808-813; Verma, Nature 389 (1994), 239; Isner, Lancet 348 (1996), 370-374; Muhlhauser, Circ. Res. 77 (1995), 1077-1086; Onodera, Blood 91 (1998), 30-36; Verma, Gene Ther. 5 (1998), 692-699; Nabel, Ann. N.Y. Acad. Sci. 811 (1997), 289-292; Verzeletti, Hum. Gene Ther. 9 (1998), 2243-51; Wang, Nature Medicine 2 (1996), 714-716; WO 94/29469; WO 97/00957, U.S. Pat. No. 5,580,859; U.S. Pat. No. 5,589,466; or Schaper, Current Opinion in Biotechnology 7 (1996), 635-640. The recited nucleic acid molecules and vectors may be designed for direct introduction or for introduction via liposomes, or viral vectors (e.g., adenoviral, retroviral) into the cell. Preferably, said cell is a germ line cell, embryonic cell, or egg cell or derived therefrom, most preferably said cell is a stem cell. An example for an embryonic stem cell can be, inter alia, a stem cell as described in, Nagy, Proc. Natl. Acad. Sci. USA 90 (1993), 8424-8428.

In accordance with the above, the present invention relates to methods to derive vectors, particularly plasmids, cosmids, viruses and bacteriophages used conventionally in genetic engineering that comprise a nucleic acid molecule encoding the polypeptide sequence of a bispecific single chain antibody construct defined herein. Preferably, said vector is an expression vector and/or a gene transfer or targeting vector. Expression vectors derived from viruses such as retroviruses, vaccinia virus, adeno-associated virus, herpes viruses, or bovine papilloma virus, may be used for delivery of the recited polynucleotides or vector into targeted cell populations. Methods which are well known to those skilled in the art can be used to construct recombinant vectors; see, for example, the techniques described in Sambrook et al. (loc cit.), Ausubel (1989, loc cit.) or other standard text books. Alternatively, the recited nucleic acid molecules and vectors can be reconstituted into liposomes for delivery to target cells. The vectors containing the nucleic acid molecules of the invention can be transferred into the host cell by well-known methods, which vary depending on the type of cellular host. For example, calcium chloride transfection is commonly utilized for prokaryotic cells, whereas calcium phosphate treatment or electroporation may be used for other cellular hosts; see Sambrook, supra.

The recited vector may, inter alia, be the pEF-DHFR, pEF-ADA or pEF-neo. The vectors pEF-DHFR, pEF-ADA and pEF-neo have been described in the art, e.g. in Mack et al. (PNAS 1995) 92, 7021-7025) and Raum et al. (Cancer Immunol Immunother (2001) 50(3), 141-150).

The invention also provides for a host transformed or transfected with a vector as described herein. Said host may be produced by introducing said at least one of the above described vector or at least one of the above described nucleic acid molecules into the host. The presence of said at least one vector or at least one nucleic acid molecule in the host may mediate the expression of a gene encoding the above described bispecific single chain antibody constructs.

The described nucleic acid molecule or vector which is introduced in the host may either integrate into the genome of the host or it may be maintained extrachromosomally.

The host can be any prokaryotic or eukaryotic cell.

The term "prokaryote" is meant to include all bacteria which can be transformed or transfected with DNA or RNA molecules for the expression of a protein of the invention. Prokaryotic hosts may include gram negative as well as gram positive bacteria such as, for example, *E. coli, S. typhimurium, Serratia marcescens* and *Bacillus subtilis*. The term "eukaryotic" is meant to include yeast, higher plant, insect and preferably mammalian cells. Depending upon the host employed in a recombinant production procedure, the protein encoded by the polynucleotide of the present invention may be glycosylated or may be non-glycosylated. Especially preferred is the use of a plasmid or a virus containing the coding sequence of the polypeptide of the invention and genetically fused thereto an N-terminal FLAG-tag and/or C-terminal His-tag. Preferably, the length of said FLAG-tag is about 4 to 8 amino acids, most preferably 8 amino acids. An above described polynucleotide can be used to transform or transfect the host using any of the techniques commonly known to those of ordinary skill in the art. Furthermore, methods for preparing fused, operably linked genes and expressing them in, e.g., mammalian cells and bacteria are well-known in the art (Sambrook, loc cit.).

Preferably, said the host is a bacteria, an insect, fungal, plant or animal cell.

It is particularly envisaged that the recited host may be a mammalian cell, more preferably a human cell or human cell line.

Particularly preferred host cells comprise CHO cells, COS cells, myeloma cell lines like SP2/0 or NS/0. As illustrated in the appended examples, particularly preferred are CHO-cells as hosts.

In a further embodiment, the present invention thus relates to a process for the preparation of a CD3 specific construct described above comprising cultivating a cell and/or the host of the invention under conditions suitable for the expression of said construct and isolating the construct from the cell or the culture medium.

The transformed hosts can be grown in fermentors and cultured according to techniques known in the art to achieve optimal cell growth. The polypeptide of the invention can then be isolated from the growth medium, cellular lysates, or cellular membrane fractions. The isolation and purification of the, e.g., microbially expressed polypeptides of the invention may be by any conventional means such as, for example, preparative chromatographic separations and immunological separations such as those involving the use of monoclonal or polyclonal antibodies directed, e.g., against a tag of the polypeptide of the invention or as described in the appended examples.

Furthermore, the invention provides for a composition comprising a (human) CD3-specific binding construct as defined herein or a (human) CD3-specific binding construct as produced by the process disclosed above, a nucleic acid molecule of the invention, a vector or a host of the invention. Said composition may, optionally, also comprise a proteinaceous compound capable of providing an activation signal for immune effector cells. Most preferably, said composition is a pharmaceutical composition further comprising, optionally, suitable formulations of carrier, stabilizers and/or excipients.

In accordance with this invention, the term "pharmaceutical composition" relates to a composition for administration to a patient, preferably a human patient. In a preferred embodiment, the pharmaceutical composition comprises a composition for parenteral, transdermal, intraluminal, intra arterial, intrathecal administration or by direct injection into the tissue or tumour. It is in particular envisaged that said pharmaceutical composition is administered to a patient via infusion or injection. Administration of the suitable compositions may be effected by different ways, e.g., by intravenous, intraperitoneal, subcutaneous, intramuscular, topical or intradermal administration. The pharmaceutical composition of the present invention may further comprise a pharmaceutically acceptable carrier. Examples of suitable pharmaceutical carriers are well known in the art and include phosphate buffered saline solutions, water, emulsions, such as oil/water emulsions, various types of wetting agents, sterile solutions, etc. Compositions comprising such carriers can be formulated by well known conventional methods. These pharmaceutical compositions can be administered to the subject at a suitable dose. The dosage regimen will be determined by the attending physician and clinical factors. As is well known in the medical arts, dosages for any one patient depends upon many factors, including the patient's size, body surface area, age, the particular compound to be administered, sex, time and route of administration, general health, and other drugs being administered concurrently. Generally, the regimen as a regular administration of the pharmaceutical composition should be in the range of 1 µg to 5 g units per day. However, a more preferred dosage for continuous infusion might be in the range of 0.01 µg to 2 mg, preferably 0.01 µg to 1 mg, more preferably 0.01 µg to 100 µg, even more preferably 0.01 µg to 50 µg and most preferably 0.01 µg to 10 µg units per kilogram of body weight per hour. Particularly preferred dosages are recited herein below. Progress can be monitored by periodic assessment. Dosages will vary but a preferred dosage for intravenous administration of DNA is from approximately $10^6$ to $10^{12}$ copies of the DNA molecule. The compositions of the invention may be administered locally or systematically. Administration will generally be parenterally, e.g., intravenously; DNA may also be administered directed to the target site, e.g., by biolistic delivery to an internal or external target site or by catheter to a site in an artery. Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishes, electrolyte replenishers (such as those based on Ringer's dextrose), and the like. Preservatives and other additives may also be present such as, for example, antimicrobials, anti-oxidants, chelating agents, and inert gases and the like. In addition, the pharmaceutical composition of the present invention might comprise proteinaceous carriers, like, e.g., serum albumine or immunoglobuline, preferably of human origin. It is envisaged that the pharmaceutical composition of the invention might comprise, in addition to the proteinaceous bispecific single chain antibody constructs or nucleic acid molecules or vectors encoding the same (as described in this invention), further biologically active agents, depending on the intended use of the pharmaceutical composition. Such agents might be drugs acting on the gastro-intestinal system, drugs acting as cytostatica, drugs preventing hyperurikemia, drugs inhibiting immunereactions (e.g. corticosteroids), drugs acting on the circulatory system and/or agents such as T-cell co-stimulatory molecules or cytokines known in the art.

Possible indications for administration of the composition(s) of the invention are tumorous diseases especially epithelial cancers/carcinomas such as breast cancer, colon cancer, prostate cancer, head and neck cancer, skin cancer (melanoma), cancers of the genito-urinary tract, e.g. ovarial cancer, endometrial cancer, cervix cancer and kidney cancer, lung cancer, gastric cancer, cancer of the small intestine, liver cancer, pancreas cancer, gall bladder cancer, cancers of the bile duct, esophagus cancer, cancer of the salivatory glands and cancer of the thyroid gland or other tumorous diseases like haematological tumors, gliomas, sarcomas or osteosarcomas. The administration of the composition(s) of the invention is especially indicated for minimal residual disease, preferably early solid tumors, advanced solid tumors or metatatic solid tumors, which is characterized by the local and non-local reoccurrance of the tumor caused by the survival of single cells.

The invention further envisages the co-administration protocols with other compounds, e.g. molecules capable of providing an activation signal for immune effector cells, for cell proliferation or for cell stimulation. Said molecule may be, e.g. a further primary activation signal for T cells (e.g. a further costimulatory molecule: molecules of B7 family, Ox40L, 4.1 BBL), or a further cytokine: interleukin (e.g. IL-2) or NKG-2D engaging compound.

The composition of the invention as described above may also be a diagnostic composition further comprising, optionally, means and methods for detection.

The CD3-specific constructs provided herein are also suited for use in immunoassays in which they can be utilized in liquid phase or bound to a solid phase carrier. Examples of immunoassays which can utilize the polypeptide of the invention are competitive and non-competitive immunoassays in either a direct or indirect format. Examples of such immunoassays are the enzyme linked immunosorbent assay (ELISA), enzyme immunoassay (EIA), radioimmunoassay (RIA), the sandwich (immunometric assay) and the Western blot assay.

The CD3 specific binding constructs of the invention can be bound to many different carriers and used to isolate cells specifically bound to said polypeptides. Examples of well-known carriers include glass, polystyrene, polyvinyl chloride, polypropylene, polyethylene, polycarbonate, dextran, nylon, amyloses, natural and modified celluloses, polyacrylamides, agaroses, and magnetite. The nature of the carrier can be either soluble or insoluble, e.g. as beads, for the purposes of the invention.

There are many different labels and methods of labeling known to those of ordinary skill in the art. Examples of the types of labels which can be used in the present invention include enzymes, radioisotopes, colloidal metals, fluorescent compounds, chemiluminescent compounds, and bioluminescent compounds; see also the embodiments discussed hereinabove.

In a most preferred embodiment of the present invention, the use of a CD3 specific binding molecule of the invention, of a vector or of a host of the invention for the preparation of a pharmaceutical composition is envisaged. Said pharmaceutical composition may be employed in the prevention, treatment or amelioration of a proliferative disease, a tumorous disease, an inflammatory disease, an immunological disorder, an autoimmune disease, an infectious disease, viral disease, allergic reactions, parasitic reactions, graft-versus-host diseases or host-versus-graft diseases.

Furthermore, in accordance to the invention, the deimmunized constructs comprising CD19 and CD3 binding domains, preferably SEQ ID NO.:190, 192, 194, 196, 198, 200, 327, 329, 331, 333, 335, 337, 339, 341, 343, 345, 347, 349, 351, 353, 357, 359; 361, 363, 365, 367, 369, 371, 373, 375, 377, 379, 381, 383, 385, 387, 389, 391, 393, 395, 397, 399, 401, 403, 405, 407 or 409, can be used for the treatment of immunological disorders (various B cell malignancies) or autoimmune diseases, the deimmunized constructs comprising CCR5 and CD3 binding domains, preferably SEQ ID NO.:206, 208, 210, 212, 214 or 216, can be used for the treatment of viral diseases (HIV), autoimmune diseases and/or of inflammatory diseases (like rheumatoid arthritis), the deimmunized constructs comprising CD20 and CD3 binding domains, preferably SEQ ID NO.:218, 220, 222, 224, 226, 228, can be used for the treatment of tumorous diseases, preferably lymphoma, more preferably non-Hodgkin's B-cell lymphoma and the deimmunized constructs comprising EpCAM and CD3 binding domains, preferably SEQ ID NO.:31, 33, 35, 37, 39, 49, 55, 58, 61, 63, 65, 67, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323 or 325 can be used for the treatment of tumorous diseases, preferably epithelial cancers.

The invention also relates to a method for the prevention, treatment or amelioration of a proliferative disease, a tumorous disease, an inflammatory disease, an immunological disorder, an autoimmune disease, an infectious disease, viral disease, allergic reactions, parasitic reactions, graft-versus-host diseases or host-versus-graft diseases comprising the administration of a (bispecific) CD3 specific binding molecule of the invention or a (bispecific) CD3 specific binding molecule as produced by the process described herein, of a nucleic acid molecule, a vector or a host of the invention to a subject in need of such a prevention, treatment or amelioration Preferably, said subject is a human.

The method for the prevention, treatment or amelioration may also, in addition, comprise the administration of a proteinaceous compound capable of providing an activation signal for immune effector cells. Said proteinaceous compound may be administered simultaneously or non-simultaneously with the CD3 binding molecule, a nucleic acid molecule, a vector or a host of the invention. The proteinaceous compound may, inter alia, selected from the group consisting of a further costimulatory molecule:molecules of B7 family, Ox40L, 4.1 BBL), or a further cytokine: interleukin (e.g. IL-2) or NKG-2D engaging compounds.

Finally, the invention provides for a kit comprising the CD3 specific binding molecule, a nucleic acid molecule, a vector or a host of the invention.

Said kit is particularly useful in the preparation of the pharmaceutical composition, of the present invention and may, inter alia, consist of a container useful for injections or infusions. Advantageously, the kit of the present invention further comprises, optionally (a) buffer(s), storage solutions and/or remaining reagents or materials required for the conduct of medical or scientific purposes. Furthermore, parts of the kit of the invention can be packaged individually in vials or bottles or in combination in containers or multicontainer units. The kit of the present invention may be advantageously used, inter alia, for carrying out the method of the invention and could be employed in a variety of applications referred herein, e.g., as research tools or medical tools. The manufacture of the kits preferably follows standard procedures which are known to the person skilled in the art.

These and other embodiments are disclosed and encompassed by the description and Examples of the present invention. Further literature concerning any one of the antibodies, methods, uses and compounds to be employed in accordance with the present invention may be retrieved from public libraries and databases, using for example electronic devices. For example, the public database "Medline", available on the Internet, may be utilized, for example under pubmed.com. Further databases and addresses, such as ncbi.nlm.nih.gov, infobiogen.fr, fmi.ch/biology/ressearch_tools, tigr.org, are known to the person skilled in the art and can also be obtained using, e.g., lycos.com.

The figures show:

FIG. 1. DNA and amino acid sequences of the non-deimmunized anti-CD3 cassette (SEQ ID NOs.: 1 and 2).

FIG. 2. A) Amino acid sequences of the heavy chains VH2 (SEQ ID NO.:70), VH3 (SEQ ID NO.:72), VH5 (SEQ ID NO.:74) and VH7 (SEQ ID NO.:76) and light chains VL1 (SEQ ID NO.:78), VL2 (SEQ ID NO.:80) and VL3 (SEQ ID NO.:82), respectively, B) Nucleotide sequences of the heavy chains VH2 (SEQ ID NO.:69), VH3 (SEQ ID NO.:71), VH5 (SEQ ID NO.:73) and VH7 (SEQ ID NO.:75) and light chains VL1 (SEQ ID NO.:77), VL2 (SEQ ID NO.:79) and VL3 (SEQ ID NO.:81), respectively, C) Amino acid sequences of the CDRs 1, 2 and 3 of the heavy chains of the non-deimmunized anti-CD3 (SEQ ID NO.:84, 90, 96, respectively), VH2 (SEQ ID NO.:86, 94, 96, respectively), VH3 (SEQ ID NO.:86, 94, 96, respectively), VH5 (SEQ ID NO.:88, 92, 96, respectively) and VH7 (SEQ ID NO.:88, 90, 96, respectively) and of the light chains of the non-deimmunized anti-CD3 (SEQ ID NO.: 98, 102, 104, respectively), chains VL1 (SEQ ID NO.:100, 102, 104, respectively), VL2 (SEQ ID NO.:100, 102, 104, respectively) and VL3 (SEQ ID NO.:98, 102, 104, respectively) and D) Nucleotide sequences of the CDRs 1, 2 and 3 of the heavy chains of the non-deimmunized anti-CD3 (SEQ ID NO.:83, 89, 95, respectively), VH2 (SEQ ID NO.:85, 93, 95, respectively), VH3 (SEQ ID NO.:85, 93, 95, respectively), VH5 (SEC), ID NO.:87, 91, 95, respectively) and VH7 (SEQ ID NO.:87, 89, 95, respectively) and of the light chains of the non-deimmunized anti-CD3 (SEQ ID NO.:97, 101, 103, respectively), chains VL1 (SEQ ID NO.:99, 101, 103, respectively), VL2 (SEQ ID NO.:99, 101, 103, respectively) and VL3 (SEQ ID NO.:97, 101, 103, respectively).

FIG. 3. A) Nucleotide sequence of anti-CD3 (VH2/VL1) (SEQ ID NO.:4) B) Amino acid sequence of anti-CD3 (VH2/VL1) (SEQ ID NO.:5) C) Nucleotide sequence of anti-CD3 (VH2/VL2) (SEQ ID NO.:6) D) Amino acid sequence of anti-CD3 (VH2/VL2) (SEQ ID NO.:7) E) Nucleotide sequence of anti-CD3 (VH2/VL3) (SEQ ID NO.:8) F) Amino acid sequence of anti-CD3 (VH2/VL3) (SEQ ID NO.:9).

FIG. 4. A) Nucleotide sequence of anti-CD3 (VH3/VL1) (SEQ ID NO.:10) B) Amino acid sequence of anti-CD3 (VH3/VL1) (SEQ ID NO.:11) C) Nucleotide sequence of anti-CD3 (VH3/VL2) (SEQ ID NO.:12) D) Amino acid sequence of anti-CD3 (VH3/VL2) (SEQ ID NO.:13) E) Nucleotide sequence of anti-CD3 (VH3/VL3) (SEQ ID NO.: 14) F) Amino acid sequence of anti-CD3 (VH3/VL3) (SEQ ID NO.:15).

FIG. 5. A) Nucleotide sequence of anti-CD3 (VH5/VL1) (SEQ ID NO.:16) B) Amino acid sequence of anti-CD3 (VH5/VL1) (SEQ ID NO.:17) C) Nucleotide sequence of anti-CD3 (VH5/VL2) (SEQ ID NO.:18) D) Amino acid sequence of anti-CD3 (VH5×VL2) (SEQ ID NO.:19) E) Nucleotide sequence of anti-CD3 (VH5/VL3) (SEQ ID NO.: 20) F) Amino acid sequence of anti-CD3 (VH5/VL3) (SEQ ID NO.:21).

FIG. 6. A) Nucleotide sequence of anti-CD3 (VH7/VL1) (SEQ ID NO.:22) B) Amino acid sequence of anti-CD3 (VH7×VL1) (SEQ ID NO.:23) C) Nucleotide sequence of anti-CD3 (VH7/VL2) (SEQ ID NO.:24) D) Amino acid sequence of anti-CD3 (VH7×VL2) (SEQ ID NO.:25) E) Nucleotide sequence of anti-CD3 (VH7/VL3) (SEQ ID NO.: 26) F) Amino acid sequence of anti-CD3 (VH7/VL3) (SEQ ID NO.:27).

Figure 7B:
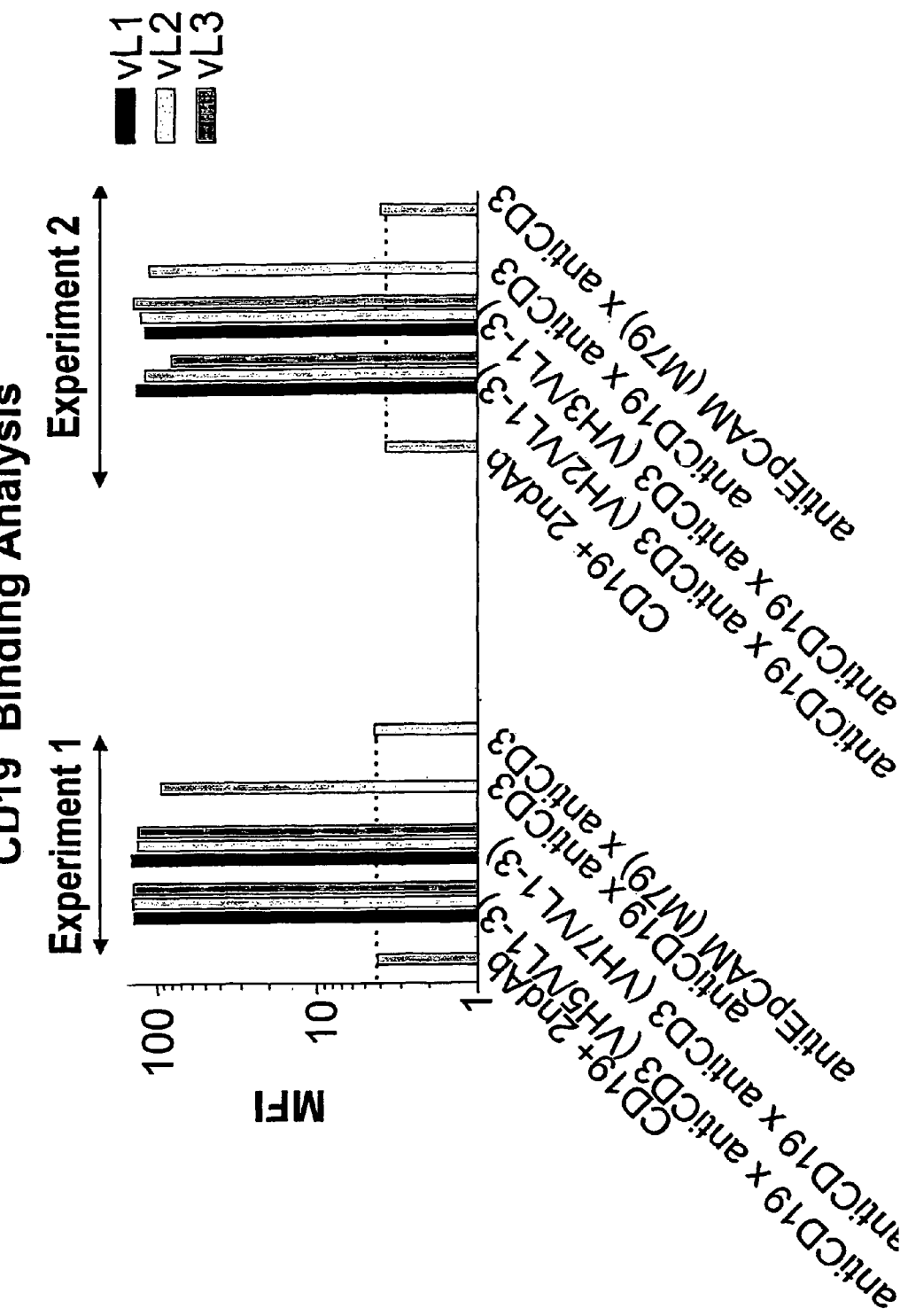

FIG. 7. Binding of bispecific anti-CD19 constructs with different deimmunized anti-CD3 parts: the anti-CD3 (VH2/VL1) (SEQ ID NO.:178), anti-CD3 (VH2/VL2) (SEQ ID NO.:180), anti-CD3 (VH2/VL3) (SEQ ID NO.:182), anti-CD3 (VH3/VL1) (SEQ ID NO.:184), anti-CD3 (VH3/VL2) (SEQ ID NO.:186), anti-CD3 (VH3/VL3) (SEQ ID NO.: 188), anti-CD3 (VH5/VL1) (SEQ ID NO.:190), anti-CD3 (VH5NK2) (SEQ ID NO.:192), anti-CD3 (VH5/VL3) (SEQ ID NO.:194), anti-CD3 (VH7/VL1) (SEQ ID NO.:196), anti-CD3 (VH7/VL2) (SEQ ID NO.:198), anti-CD3 (VH7/VL3)

(SEQ ID NO.:200) A) CD3 and B) CD19. Binding was measured by a FACS-based assay using CD3 enriched PBMCs (A) or CD19-positive NALM-cells (B). CD3 and a secondary FITC labeled anti-mouse Ig antibody was used as a negative control in (A) and CD19 and a secondary FITC labeled anti-mouse Ig antibody was used as a negative control in (B). Constructs anti-CD19×anti-CD3 and anti-EpCAM (M79)×anti-CD3 were used as controls. MFI indicates mean fluorescence intensity.

Figure 8:
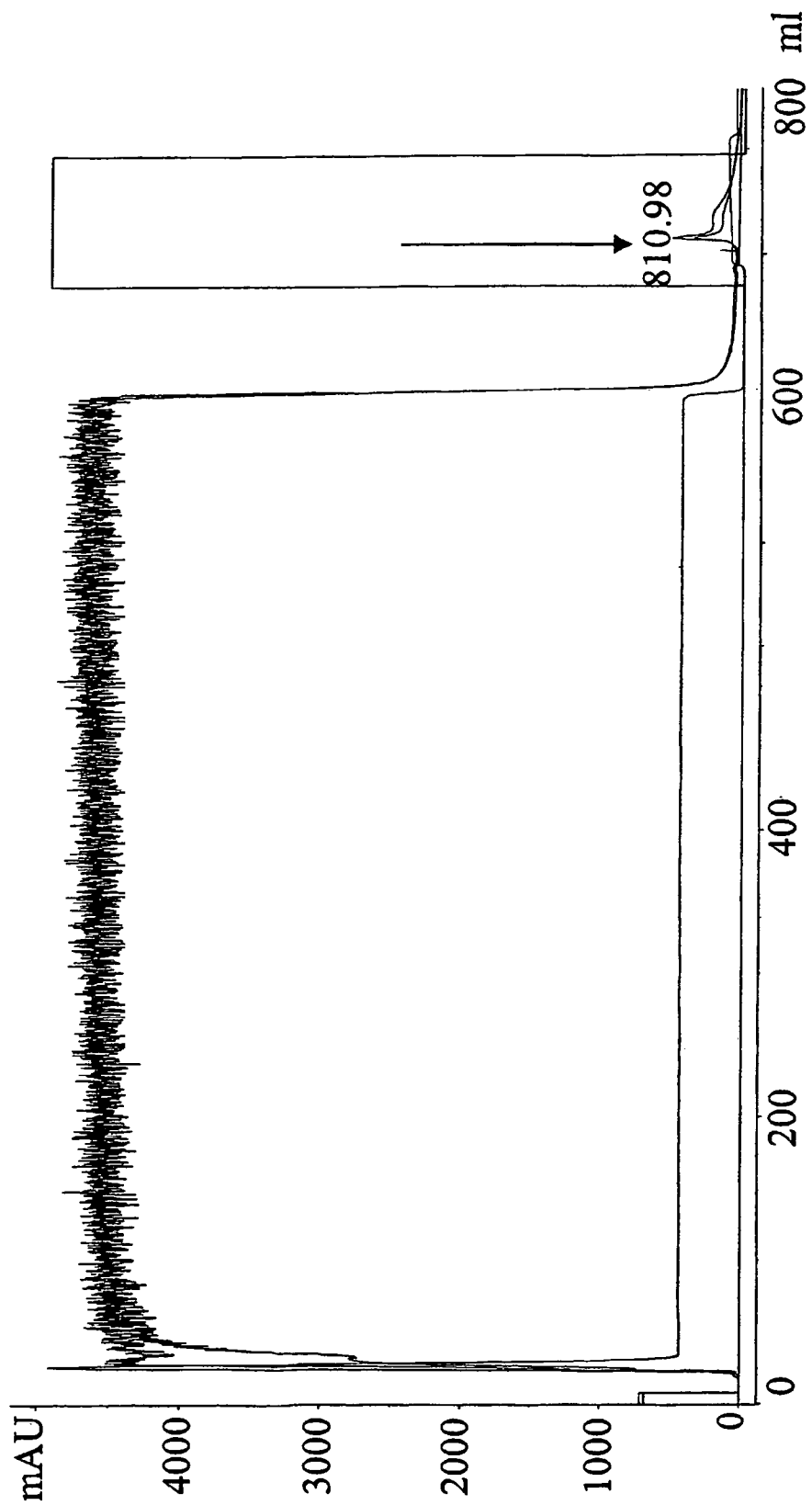

FIG. 8: A representative elution pattern of a deimmunized variant of anti-CD19×anti-CD3 protein fraction from a HClC column at 280 nm. The bottom line showing a major step at 700 ml indicates the theoretical gradient of the elution buffer containing 20 mM acetate, pH3.5. High adsorption at 280 nm was due to non-bound protein in the column flow-through. The arrow at 810.98 ml indicates the eluted deimmunized anti-CD3 fraction.

Figure 9:
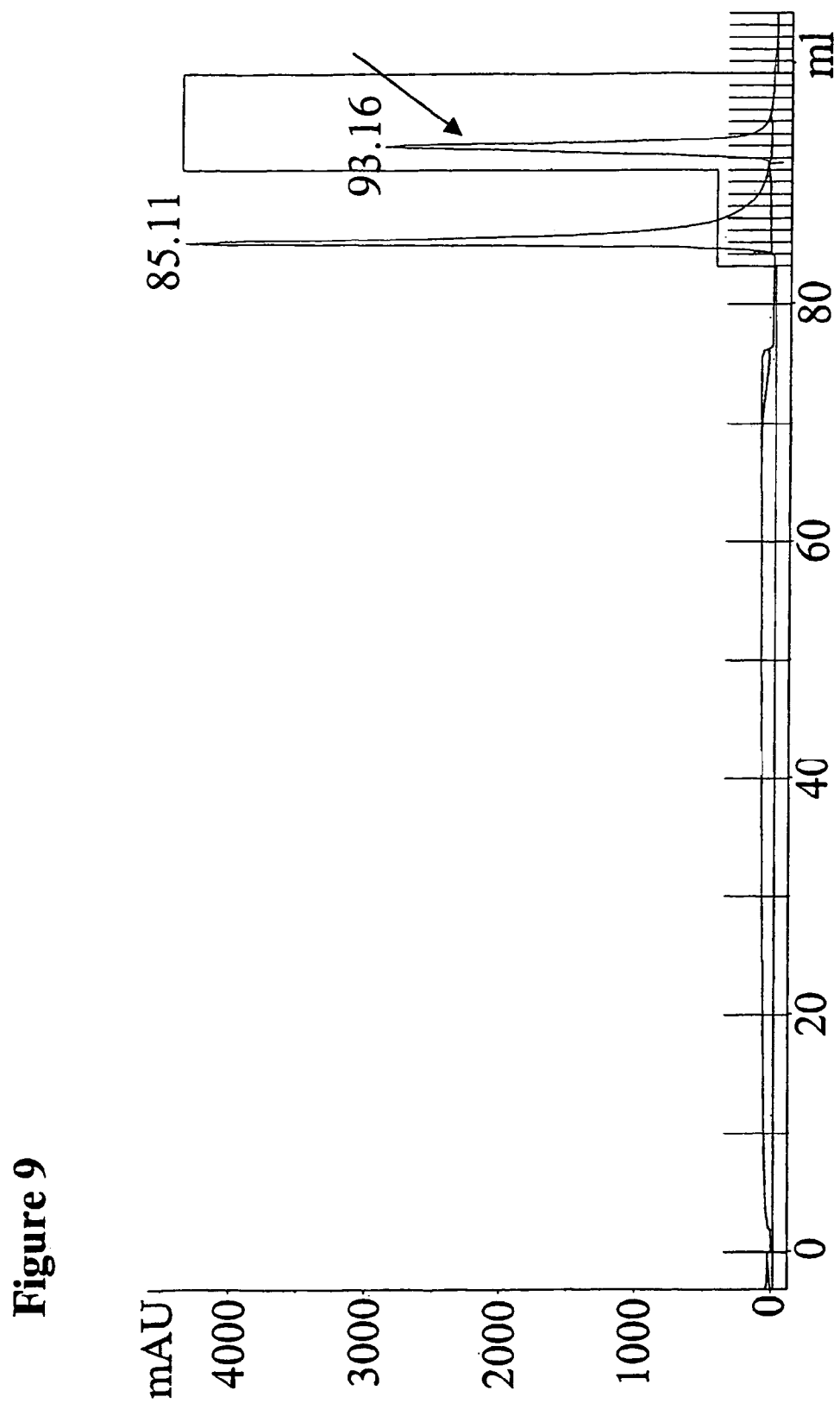

FIG. 9: A representative elution pattern of a deimmunized variant of anti-CD19×anti-CD3 protein fraction from a Ni-Chelating His Trap® column at 280 nm. The bottom line showing a first step at 85 ml and a second major step at 90 ml indicates the theoretical gradient of the elution buffer (dotted line). The arrow at 93.16 ml indicates the protein fraction containing the antiCD19×antiCD3 construct.

Figure 10:
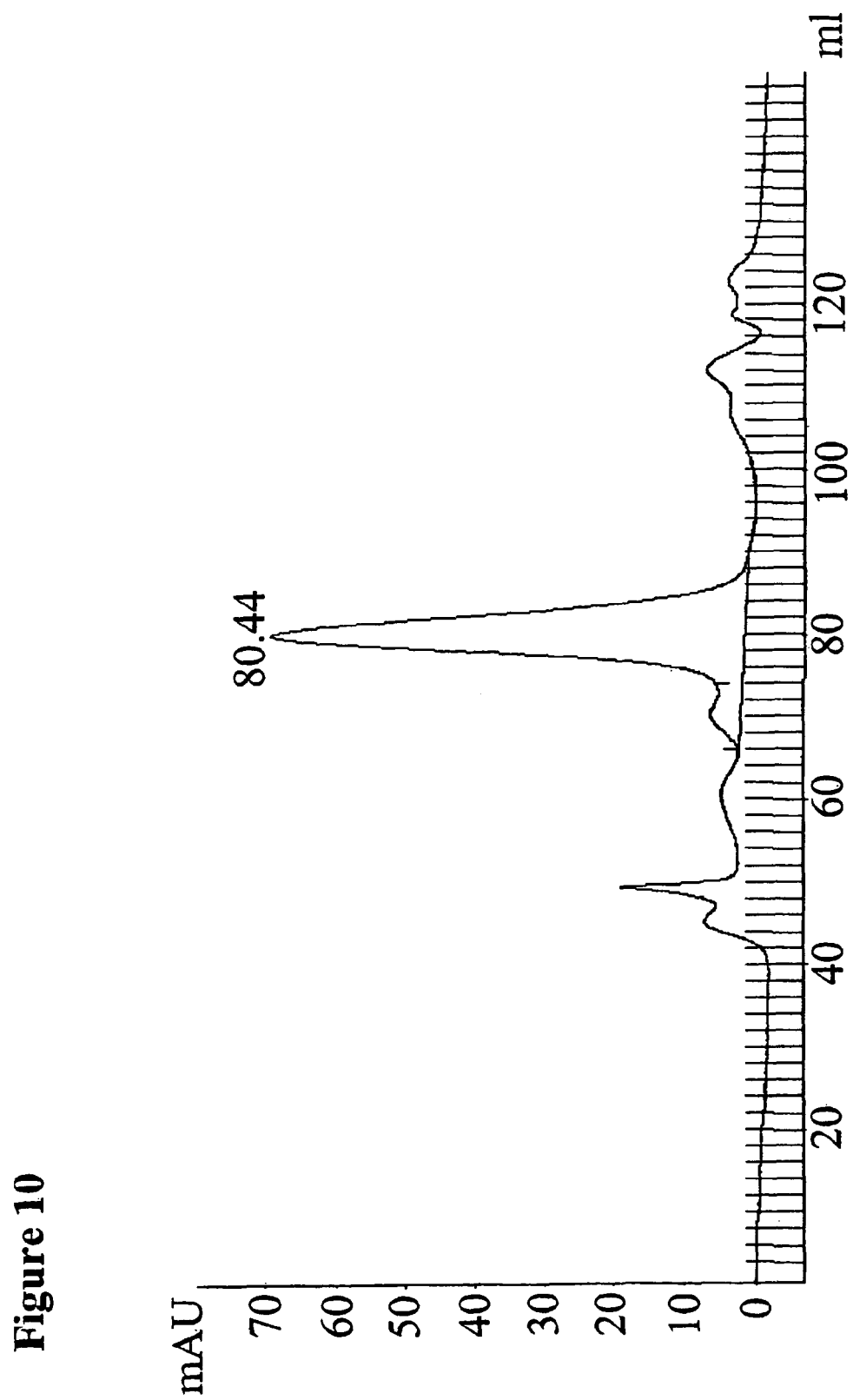

FIG. 10: A representative protein elution pattern from a Sephadex S200 gelfiltration column. Fractions were collected from 0-130 ml retention time. The protein peak at 80.44 ml corresponds to a MW of ca. 52 kD and contains the deimmunized antiCD19×antiCD3 construct.

FIG. 11: A) SDS-PAGE analysis of deimmunized variants of anti-CD19×anti-CD3 protein fractions. Lane M: Molecular weight marker Lane 1: HClC flowthrough; lane 2: cell culture supernatant; lane 3: HClC eluate; lane 4: IMAC flowthrough; lane 5: IMAC wash; lane 6: IMAC eluate; lane 7: gel filtration eluate; B) Western blot analysis of purified deimmunized variants of anti-CD19×anti-CD3 protein fractions. Western blot analysis of purified bispecific protein was performed with antibodies directed against the His-Tag (PentaHis, Qiagen) and goat anti mouse Ig labeled with alkaline phosphatase. Lane M: Molecular weight marker Lane 1: HClC flow through; lane 2: cell culture supernatant; lane 3: HClC eluate; lane 4: IMAC flow through; lane 5: IMAC wash; lane 6: IMAC eluate; lane 7: gel filtration eluate.

FIG. 12. Binding of the purified bispecific anti-CD19 constructs with different deimmunized anti-CD3 parts: anti-CD3 (VH5/VL1) (SEQ ID NO.:190), anti-CD3 (VH7/VL1) (SEQ ID NO.:196), anti-CD3 (VH7/VL2) (SEQ ID NO.:198) and anti-CD3 (VH7/VL3) (SEQ ID NO.:200) to A) CD3 and B) CD19 compared to the wild-type anti-CD19×anti-CD3 construct. Binding was measured by a FACS-based assay using CD3 enriched PBMCs (A) or CD19-positive NALM-cells (B). A secondary antibody with CD3 positive cells was used as a negative control in (A) and a secondary antibody with CD19 positive cells was used as a negative control in (B). Constructs anti-CD19×anti-CD3 and anti-EpCAM (M79)×anti-CD3 were used as controls. Assay was carried out with concentrations of 1 µg/ml and 5 µg/ml. MFI indicates mean fluorescence intensity.

Figure 13:
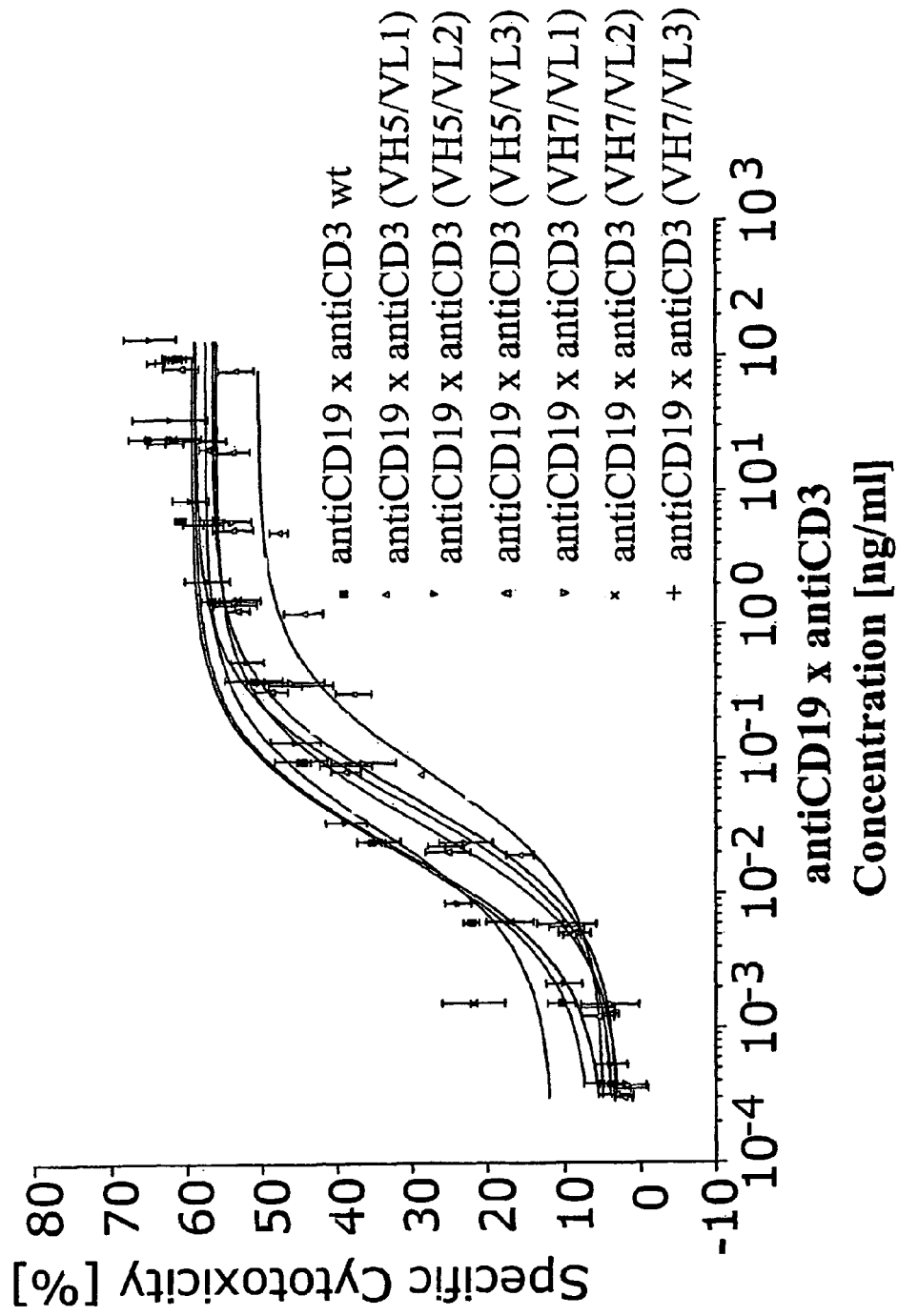

FIG. 13. Cytotoxicity assay of bispecific anti-CD19 constructs with different deimmunized anti-CD3 parts anti-CD3 (VH5/VL1) (SEQ ID NO.:190), anti-CD3 (VH5/VL2) (SEQ ID NO.:192), anti-CD3 (VH5/VL3) (SEQ ID NO.:194), anti-CD3 (VH7/VL1) (SEQ ID NO.:196), anti-CD3 (VH7/VL2) (SEQ ID NO.:198) and anti-CD3 (VH7NK3) (SEQ ID NO.: 200) compared to control.

FIG. 14. Sequence alignment of variable heavy region of the non-deimmunized CD3 antibody (SEQ ID NO: 110), VH5 (SEQ ID NO.:74), VH7 (SEQ ID NO.:76), VH2 (SEQ ID NO.:70) and VH3 (SEQ ID NO.:72). Framework region 1 (FR1), complementarity determining region 1 (CDR1), Framework region 1 (FR1), complementarity determining region 2 (CDR2), Framework region 3 (FR3), complementarity determining region 3 (CDR3) and Framework region 4 (FR4) have been depicted. The sequence LAR and VKK in FR1, the sequence ASGYTF (SEQ ID NO: 233) and ASGYTA (SEQ ID NO: 4111 at the transition of framework 1 region to CDR1 region and the sequence LTTDK (SEQ ID NO: 412), ITTDK (SEQ ID NO: 235) and MTTDT (SEQ ID NO: 413 at FR3 and the sequence MQLS (SEQ ID NO: 414), MELS (SEQ ID NO: 234) and LQMN (SEQ ID NO: 415) at FR3 have been boxed. Alignment was carried out using the AlingnX program of Vector NTI Advance (Informax, Inc., USA).

FIG. 15. Binding analysis of bispecific anti EpCAM constructs with different deimmunized anti-CD3 parts: anti-CD3 (VH5/VL2)×5-10 (SEQ ID NO.:37) (A), deimmunized anti-CD3 (VH5/VL2)$_{x4}$-7 (SEQ ID NO.:33), (B) deimmunized anti-CD3 (VH5/VL2)×3-1 (SEQ ID NO.:31) (C), deimmunized anti-CD3 (VH5/VL2)×4-7 (VL-VH) (SEQ ID NO.:35) (D) and deimmunized anti-CD3 (VH5/VL2)×5-10 (VL-VH) (SEQ ID NO.:39) (E) in CD3-positive Jurkat and EpCAM-positive Kato III cells with a FACS-based assay. A shift to the right shows binding. In Jurkat cells the dotted line indicates the shift of the negative control (only secondary antibody), dashed line shows the binding of an anti-EpCAM-anti-CD3 control antibody, the bold line shows the bispecific construct of interest. In the binding assay using EpCAM-positive Kato III-cells instead of monoclonal antibody to CD3 a monoclonal antibody to EpCAM was used as a positive control.

FIG. 16. Binding analysis of bispecific anti EpCAM constructs with different deimmunized anti-CD3 parts: 3-1×anti-CD3 (VH5/VL2) (SEQ ID NO.:49) (A) and 5-10×anti-CD3 (VH5/VL2) (SEQ ID NO.:63) (B) in CD3-positive Jurkat cells and in EpCAM-positive Kato cells with a FACS based assay. A shift to the right shows binding.

Figure 17:
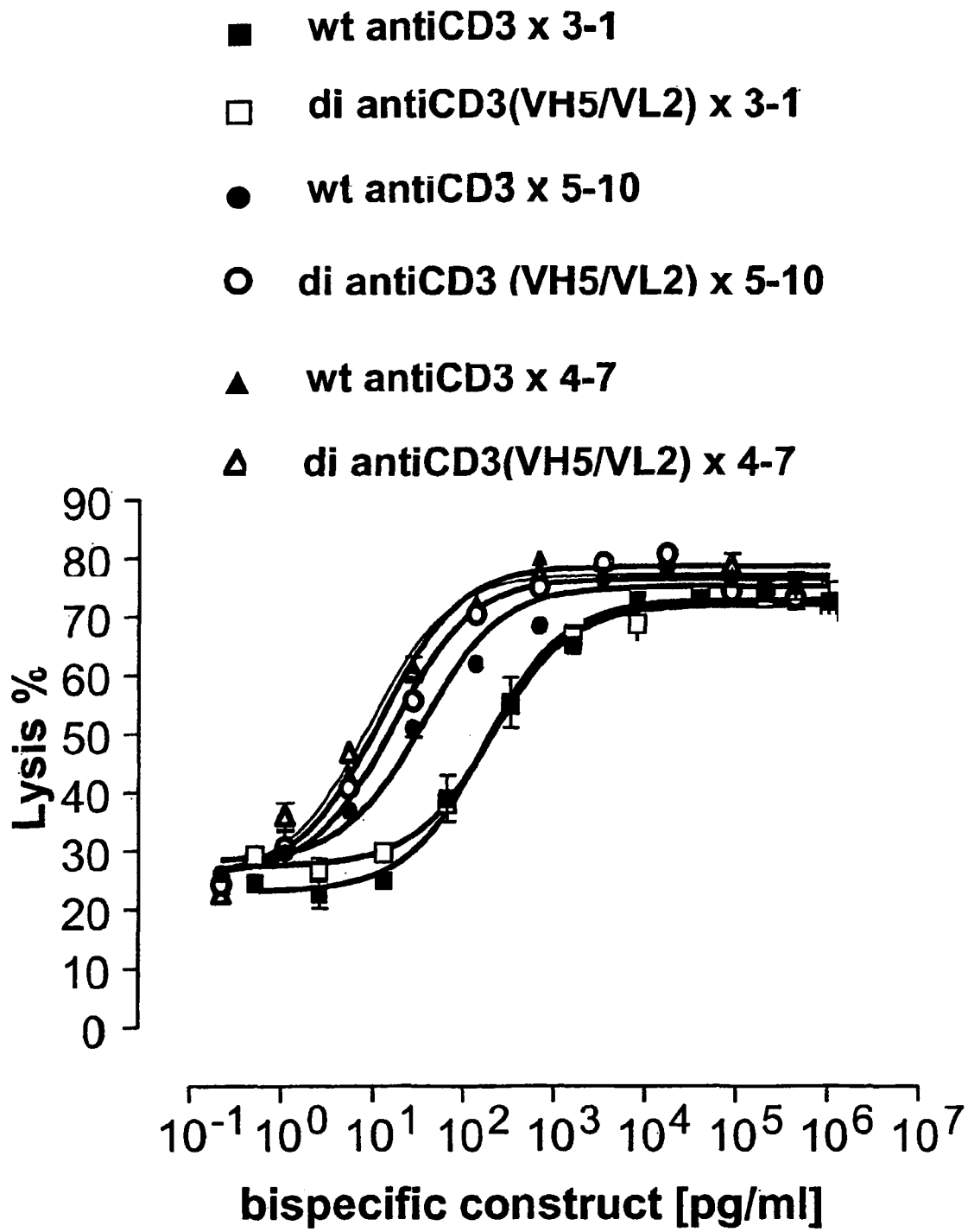

FIG. 17. Cytotoxicity assay of EpCAM constructs with deimmunized anti-CD3 parts (di anti-CD3) at N-terminal position anti-CD3 (VH5/VL2)$_{x3}$-1 (SEQ ID NO.:31), anti-CD3 (VH5/VL2)$_x$-5-10 (SEQ ID NO.:37) and anti-CD3 (VH5/VL2)$_{x4}$-7 (SEQ ID NO.:33) compared to the corresponding non-deimmunized constructs. CB15 T cell clone and CHO-EpCAM cells were used in an E:T ratio of 5:1. CHO-EpCAM cell were stained with PKH26 dye and the cells were counted after bispecific single chain antibody incubation with FACS analysis.

Figure 18:
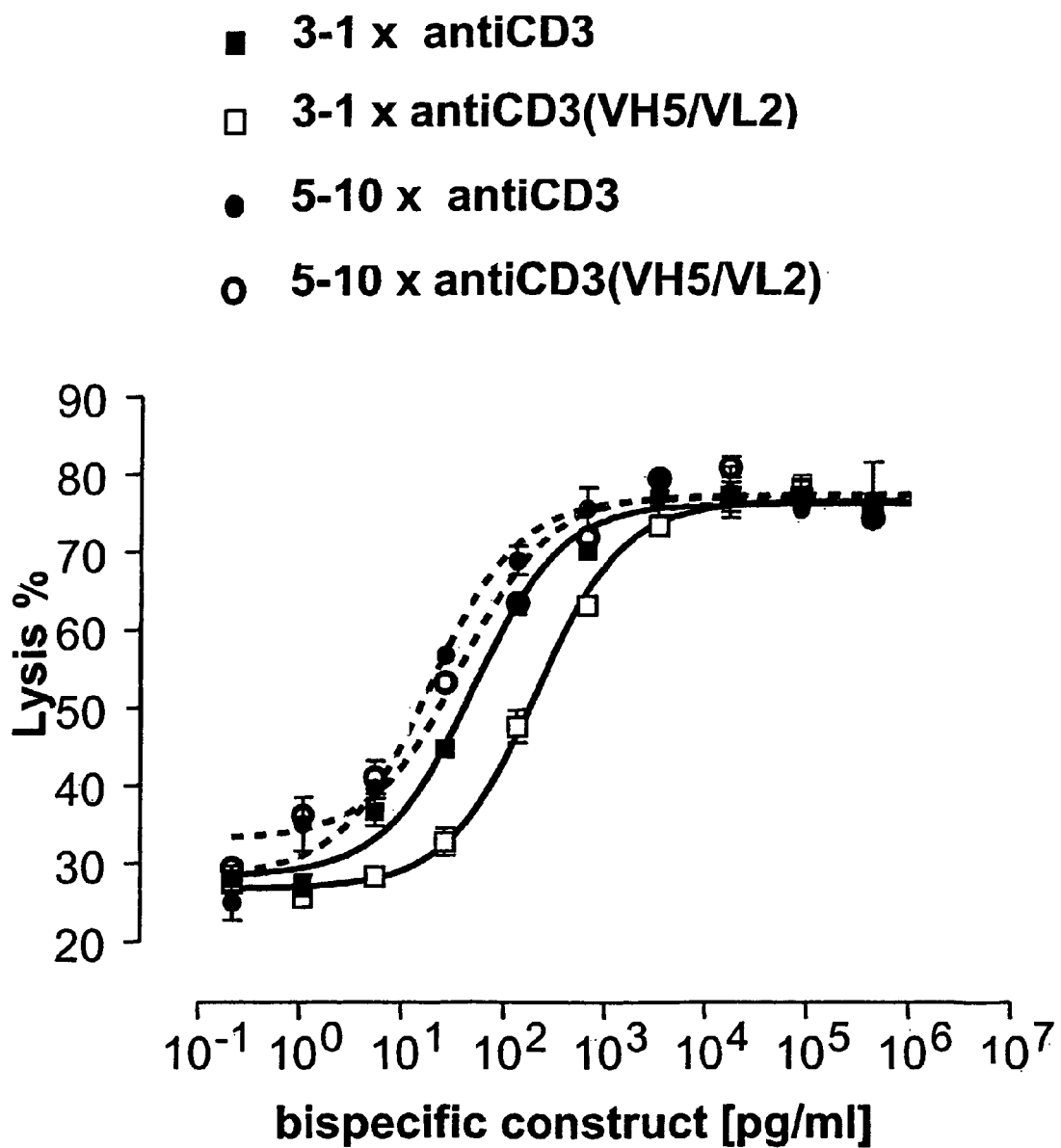

FIG. 18. Cytotoxicity assay of EpCAM constructs with deimmunized anti-CD3 parts at the C-terminal position 3-1×anti-CD3 (VH5/VL2) (SEQ ID NO.:49) and 5-10×anti-CD3 (VH5/VL2) (SEQ ID NO.:63) compared to the corresponding non-deimmunized wild-type constructs. Cytotoxicity assay was carried out identically to FIG. 17.

The following Examples illustrate the invention:

In the following examples a number of single chain anti-human CD3 antibodies have been engineered to show reduced immunogenicity in man. The different deimmunized anti-human CD3 antibodies comprise 12 combinations of 4 different VH (VH2 (SEQ ID NO.:69, 70), VH3 (SEQ ID NO.:71, 72), VH5 (SEQ ID NO.:73, 74) and VH7 (SEQ ID NO.:75, 76)) and 3 different VL (VL1 (SEQ ID NO.:77, 78), VL2 (SEQ ID NO.:79, 80) and VL3 (SEQ ID NO.:81, 82)) regions joined together. The amino acid and nucleic acid sequences of the above-mentioned VH and VL regions are shown in FIGS. 3-6. Illustratively, the deimmunized anti-CD3 single chain antibodies were combined with an anti-CD19 single chain antibody or with an anti-EpCAM single chain antibody in order to form a bispecific product.

EXAMPLE 1

Cloning and Expression of Deimmunized Anti-CD3 Constructs 1.1. Transfer of cDNA Encoding Single Chain Antibody The DNA encoding the anti-CD3 single-chain antibody, which was deimmunized, is referred herein as the anti-CD3 cassette. This anti-CD3 cassette consists of a SGGGGS linker (SEQ ID NO.:176), the anti-CD3 VH region (SEQ ID NO.: 110), a 14 amino acid GS linker (VEGGSGGSGGSGGSG-GVD linker (SEQ ID NO.:68)), and the anti-CD3 VL chains region (SEQ ID NO.:112) followed by 6 histidine residues. The afore-mentioned DNA was cloned into the vector p-PCR-Script-Amp SK(+) (Stratagene) at the Stf1 site. The DNA and amino acid sequence of the anti-CD3 cassette is shown in SEQ ID NO.:1, SEQ ID NO.:2 and FIG. 1.

1.2 Computer Analysis of Sequences for Immunogenic T Cell Epitopes and Design of Deimmunized Single Chain Antibody Sequences The amino acid sequence of the anti-CD3 cassette (SEQ ID NO.:2) was analyzed by peptide threading program to identify potential T cell epitopes with the method as described in WO 98/52976. SEQ ID NO.3 shows the deimmunized linker sequence and SEQ ID NO.:68 the original linker sequence.

1.3 Construction of Deimmunized Single Chain Antibody Sequences

The deimmunized versions of the anti-CD3 cassette were constructed by the method of overlapping PCR recombination. The anti-CD3 cassette (SEQ ID NO.:1, 2) in pPCR-S-Amp SK+ was used as the template for mutagenesis to the required deimmunized sequences. Sets of mutagenic primer pairs were synthezised encompassing the regions to be altered. The deimmunized sequences produced, including 4 different VH and 3 different VL regions, were cloned as Not1 to Hind111 fragments into the vector pPCR-S-Amp SK+ and the entire DNA sequence was confirmed to be correct. The 4 different VH and 3 different VK regions were joined in all combinations (a total of 12), either by PCR or using a unique BstE11 site introduced at the 3' end of the VH region. The entire DNA sequence of each combination was confirmed to be correct. The different deimmunized VH regions (SEQ ID NO.:70, 72, 74 and 76) and VL regions (SEQ ID NO.:78, 80 and 82) with the corresponding original non-deimmunized sequences (VH:SEQ ID NO.:110; VL:SEQ ID NO.:112) of the anti-CD3 constructs are summarized in Table 9.

TABLE 9

SEQ ID NOs.: of deimmunized VH and VL regions

|  | SEQ ID NO.: | | SEQ ID NO.: CDR1 | | SEQ ID NO.: CDR2 | | SEQ ID NO.: CDR3 | |
| --- | --- | --- | --- | --- | --- | --- | --- | --- |
|  | Nucleic acid | Amino acid | Nucleic acid | Amino acid | Nucleic acid | Amino acid | Nucleic acid | Amino acid |
| Deimmunized VH2 | 69 | 70 | 85 | 86 | 93 | 94 | 95 | 96 |
| Deimmunized VH3 | 71 | 72 | 85 | 86 | 93 | 94 | 95 | 96 |
| Deimmunized VH5 | 73 | 74 | 87 | 88 | 91 | 92 | 95 | 96 |
| Deimmunized VH7 | 75 | 76 | 87 | 88 | 89 | 90 | 95 | 96 |
| VH of the non-deimmunized CD3 | 109 | 110 | 83 | 84 | 89 | 90 | 95 | 96 |
| VH of the non-deimmunized CD3 with Cys→Ser Mutation | 105 | 106 | 83 | 84 | 89 | 90 | 107 | 108 |
| Deimmunized VL1 | 77 | 78 | 99 | 100 | 101 | 102 | 103 | 104 |
| Deimmunized VL2 | 79 | 80 | 99 | 100 | 101 | 102 | 103 | 104 |
| Deimmunized VL3 | 81 | 82 | 97 | 98 | 101 | 102 | 103 | 104 |
| VL of the non-deimmunized CD3 | 111 | 112 | 97 | 98 | 101 | 102 | 103 | 104 |

1.4 Transfer of Deimmunized Single Chain Antibody Genes into Expression Vector

The deimmunized anti-CD3 cassettes were excised from pPCR-S-Amp-SK+ with BspE1 and Sal1 and cloned into the expression vector pEF comprising $VL_{cD19}$-$VH_{cD19}$—$VH_{cD3}$—$VL_{cD3}$. The CD3 part of the pEF-DHFR vector was replaced with each of the deimmunized anti-CD3 cassettes from the BspE1 site to the Sal1 site resulting in the following 12 constructs:

pEF anti-CD19×anti-CD3 (VH2/VL1) (SEQ ID NOs.: 177, 178)
pEF anti-CD19×anti-CD3 (VH2/VL2) (SEQ ID NOs.: 179, 180)
pEF anti-CD19×anti-CD3 (VH2/VL3) (SEQ ID NOs.: 181, 182)
pEF anti-CD19×anti-CD3 (VH3/VL1) (SEQ ID NOs.: 183, 184)
pEF anti-CD19×anti-CD3 (VH3/VL2) (SEQ ID NOs.: 185, 186)
pEF anti-CD19×anti-CD3 (VH3/VL3) (SEQ ID NOs.: 187, 188)
pEF anti-CD19×anti-CD3 (VH5/VL1) (SEQ ID NOs.: 189, 190)
pEF anti-CD19×anti-CD3 (VH5/VL2) (SEQ ID NOs.: 191, 192)
pEF anti-CD19×anti-CD3 (VH5/VL3) (SEQ ID NOs.: 193, 194)
pEF anti-CD19×anti-CD3 (VH7/VL1) (SEQ ID NOs.: 195, 196)
pEF anti-CD19×anti-CD3 (VH7/VL1) (SEQ ID NOs.: 197, 198)
pEF anti-CD19×anti-CD3 (VH7/VL3) (SEQ ID NOs.: 199, 200).

The constructs further comprises a murine IgG heavy chain leader in order to enable the secretion of the protein. The DNA sequences of the deimmunized anti-CD3 cassettes in the expression vector were confirmed using the sequencing primers (SEQ ID NO.: 28 and 29). The DNA and amino acid sequences of the 12 deimmunized anti-CD3 cassettes in the pEF vector from the BspE1 site to the Sal1 site are shown in SEQ ID NOs.: 177-200.

1.5 Production of Antibody Constructs

After transformation of the vector into *E. coli* K12, transfection-grade DNAs of the different expression vectors were prepared. Secreted proteins were produced in CHO-dhfr- cells. For transient production the cell culture supernatants were harvested 2 days after transfection, for the generation of stable transfected cells, cells were put in selection medium two days after transfection. After five passages, stable pools were obtained. Subsequently, single clones were identified in limiting dilutions. To facilitate the purification process, the cells were adapted to serum-free medium. Antibody constructs were purified from about 1 liter of supernatant. The production levels were tested in ELISA. No major differences in the secreted antibody levels were observed between different constructs comprising anti-CD19 and deimmunized anti-CD3 constructs.

EXAMPLE 2

Binding Assays

In order to analyze the binding efficacy of the deimmunized constructs to CD3 and CD19 a FACS-based assay was performed. Initially, crude supernatants were tested for binding on CD3-enriched PBMCs or CD19-positive NALM-6 cells. Cells were incubated with non-diluted supernatants for 30 minutes at 8° C. Upon two wash steps the cells were labeled with an anti-His antibody (Qiagen) under the same conditions. After additional wash steps binding of the constructs was detected with a FITC-conjugated sheep anti-mouse antibody (Sigma). Cells were analyzed with a FACS Calibur cytometer (B&D). As controls supernatants of anti-CD19×anti-CD3 and GFP-transfected cells were included. CD3 and a secondary antibody was used as a negative control and it showed a mean fluorescence intensity (MFI) of ca. 3.5. The anti-CD19×anti-CD3 constructs comprising anti-CD3 (VH5/VL1) (SEQ ID NO.:190), anti-CD3 (VH5/VL2) (SEQ ID NO.:192), anti-CD3 (VH5/VL3) (SEQ ID NO.:194), anti-CD3 (VH7/VL1) (SEQ ID NO.:196), anti-CD3 (VH7/VL2) (SEQ ID NO.:198) and anti-CD3 (VH7/VL3) (SEQ ID NO.: 200) had a MFI of at least 90, thus binding about 25 times more strongly. The positive control, which was a non-deimmunized anti-CD19×anti-CD3 construct reached a MFI of around 60 showing that the deimmunized constructs comprising anti-CD3 (VH5/VL1) (SEQ ID NO.:190), anti-CD3 (VH5/VL2) (SEQ ID NO.:192), anti-CD3 (VH5/VL3) (SEQ ID NO.:194), anti-CD3 (VH7/VL1) (SEQ ID NO.:196), anti-CD3 (VH7/VL2) (SEQ ID NO.:198) and anti-CD3 (VH7/VL3) (SEQ ID NO.:200) bound CD3 with extremely high efficacy. In a second experiment, the following constructs comprising anti-CD19 and anti-CD3: anti-CD3 (VH2/VL1) (SEQ ID NO.:178), anti-CD3 (VH2/VL2) (SEQ ID NO.: 180), anti-CD3 (VH2/VL3) (SEQ ID NO.:182, anti-CD3 (VH3/VL1) (SEQ ID NO.:184), anti-CD3 (VH3/VL2) (SEQ ID NO.:186) and anti-CD3 (VH3/VL3) (SEQ ID NO.:188), showed similar binding as the negative control (MFI ca. 6).

The FACS-based binding assay was also carried out for CD19. In this experiment CD19 and a secondary antibody was as a negative control. In this experiment, all assayed constructs achieved a MFI of at least 80 while the MFI of the negative control was ca. 3.

Thus, the constructs comprising anti-CD3 (VH5/VL1) (SEQ ID NO.:190), anti-CD3 (VH5/VL2) (SEQ ID NO.: 192), anti-CD3 (VH5/VL3) (SEQ ID NO.:194), anti-CD3 (VH7/VL1) (SEQ ID NO.:196), anti-CD3 (VH7/VL2) (SEQ ID NO.:198) and anti-CD3 (VH7/VL3) (SEQ ID NO.:200) turned out to bind as well CD3 and CD19 as the non-modified anti-CD19×anti-CD3 (SEQ ID NO.:204). However, the constructs anti-CD3 (VH2/VL1) (SEQ ID NO.:178), anti-CD3 (VH2/VL2) (SEQ ID NO.:180), anti-CD3 (VH2/VL3) (SEQ ID NO.:182), anti-CD3 (VH3/VL1) (SEQ ID NO.:184), anti-CD3 (VH3/VL2) (SEQ ID NO.:186), anti-CD3 (VH3/VL3) (SEQ ID NO.:188) had completely lost anti-CD3 binding capacity, while CD19 binding was fully retained (FIG. 7).

Thus, it was demonstrated that the deimmunized heavy chains dominated the binding specificity and strength. As a result, the anti-CD3 constructs with VH5 and VH7 groups were purified and analyzed for cytotoxic activity.

EXAMPLE 3

Expression and Purification of the Variants Showing High Binding Affinity

The deimmunized anti-CD19×anti-CD3 proteins anti-CD3 (VH5/VL1) (SEQ ID NO.:190), anti-CD3 (VH5/VL2) (SEQ ID NO.:192), anti-CD3 (VH5/VL3) (SEQ ID NO.: 194), anti-CD3 (VH7/VL1) (SEQ ID NO.:196), anti-CD3 (VH7/VL2) (SEQ ID NO.:198) and anti-CD3 (VH7/VL3) (SEQ ID NO.:200) were expressed in chinese hamster ovary cells (CHO).

In order to purify the bispecific single-chain constructs comprising a deimmunized anti-CD3 part CHO-CD19 cells were grown in roller bottles with HiClone CHO modified DMEM medium (HiQ)® for 7 days before harvest. The cells were removed by centrifugation and the supernatant, containing the expressed protein was stored at −20° C.

Äkta FPLC System® (Pharmacia) and Unicorn Software® were used for chromatography. All chemicals were of research grade and purchased from Sigma (Deisenhofen) or Merck (Darmstadt).

Hydrophobic charge induction chromatography was performed on MEP Hypercel® medium loaded to a XK16/60 column (Pharmacia) that was equilibrated with buffer A1 (20 mM Tris pH 7.2). 500 ml of cell culture supernatant were applied to the column (10 ml) with a flow rate of 3 ml/min. Unbound sample was washed out with buffer A1 and the bound protein was eluted with 100% buffer B1 (20 mM acetate pH 3.5). Eluted protein fractions were pooled for further purification.

IMAC was performed, using a HisTrap® column (Pharmacia) that was loaded with $NiSO_4$ according to the manufacturers protocol. The column was equilibrated with buffer A2 (20 mM NaP pH 7.5, 0.4 M NaCl) and the sample was diluted 2:1 with buffer A2 to obtain a pH of 7. The sample was applied to the column (2 ml) with a flow rate of 1 ml/min and the column was washed with buffer A2 to remove unbound sample. Bound protein was eluted using a 2 step gradient of buffer B2 (20 mM NaP pH 7.5, 0.4 M NaCl, 0.5 M Imidazol) Step 1: 20% buffer B2 in 10 column volumes; Step 2: 100% buffer B2 in 10 column volumes. Eluted protein fractions were pooled for further purification.

Gel filtration chromatography was performed on a Sephadex S200 HiPrep® column (Pharmacia) equilibrated with PBS (Gibco). Eluted protein samples (flow rate 1 ml/min) were subjected to SDS-Page and Western Blot for detection (FIG. 11). The column was previously calibrated for molecular weight determination (molecular weight marker kit, Sigma MW GF-200).

The deimmunized variants of anti-CD19×anti-CD3 protein were isolated in a three step purification process including hydrophobic charge induction chromatography (HCIC) (FIG. 8), immobilized metal affinity chromatography (IMAC) (FIG. 9) and gel filtration (FIG. 10). The bispecific construct had a molecular weight of 52 kDa under native conditions as determined by gelfiltration in PBS.

The purified bispecific protein was analyzed with SDS-PAGE under reducing conditions using precast 4-12% Bis Tris gels (Invitrogen). Sample preparation and application were according to the manufacturer's protocol. The molecular weight was determined with MultiMark® protein standard (Invitrogen). The gel was stained with colloidal Coomassie (Invitrogen protocol). The purity of the isolated protein was >95% (FIG. 11a) and the molecule has a size of 52 kD.

Furthermore, the deimmunized variants of anti-CD19×anti-CD3 protein were specifically detected by Western Blot. Western Blot was performed with an Optitran BA-S83® membrane and the Invitrogen Blot Module® according to the manufacturer's protocol. The antibodies used were Penta His (Quiagen) and Goat-anti-Mouse-Ig labeled with alkaline phophatase (AP) (Sigma), the staining solution was BCIP/NBT liquid (Sigma). The main signal was shown to correspond to the main band in the SDS-PAGE at 52 kD (FIG. 11b).

Protein concentrations were determined using protein assay dye (MicroBCA®, Pierce) and IgG (Biorad) as standard protein. A summary of the final yields of purified protein variants is given in Table 10 showing the high productivity of all the constructs and very good yield of construct with anti-CD3 (VH5/VL1) (SEQ ID NO.:190) of 924.8 μg.

TABLE 10

Protein yields of the deimmunized anti-CD19-anti-CD3 constructs

| Deimmunized CD3 construct | Yield [μg/supernatant] |
|---|---|
| CD19 × anti CD3 (VH5/VL1)(SEQ ID NO.: 190) | 924.8 |
| CD19 × anti CD3 (VH5/VL2)(SEQ ID NO.: 192) | 446.7 |
| CD19 × anti CD3 (VH5/VL3)(SEQ ID NO.: 194) | 218.4 |
| CD19 × anti CD3 (VH7/VL1)(SEQ ID NO.: 196) | 268.5 |
| CD19 × anti CD3 (VH7/VL2)(SEQ ID NO.: 198) | 553.4 |
| CD19 × anti CD3 (VH7/VL3) (SEQ ID NO.: 200) | 477.3 |

The productivity of the CD19×anti-CD3 (VH5/VL2) and CD19×anti-CD3(VH7/VL2) constructs was compared with the corresponding non-deimmunized constructs. The results are shown in Table 11.

TABLE 11

Yields of the deimmunized bispecific construct compared to the corresponding non-deimmunized construct

| Construct | Yield (μg/l) |
|---|---|
| CD19 × anti-CD3 | 62 |
| CD19 × antiCD3 (VH5/VL2) | 204 |
| CD19 × antiCD3 (VH7/VL2) | 310 |

Table 11 clearly demonstrates that the bispecific constructs comprising deimmunized CD3 binding domain have much higher (at least three fold) productivity than the corresponding non-deimmunized construct.

EXAMPLE 4

FACS Based Binding Assays of the Anti-CD3 Constructs

Figure 12A:
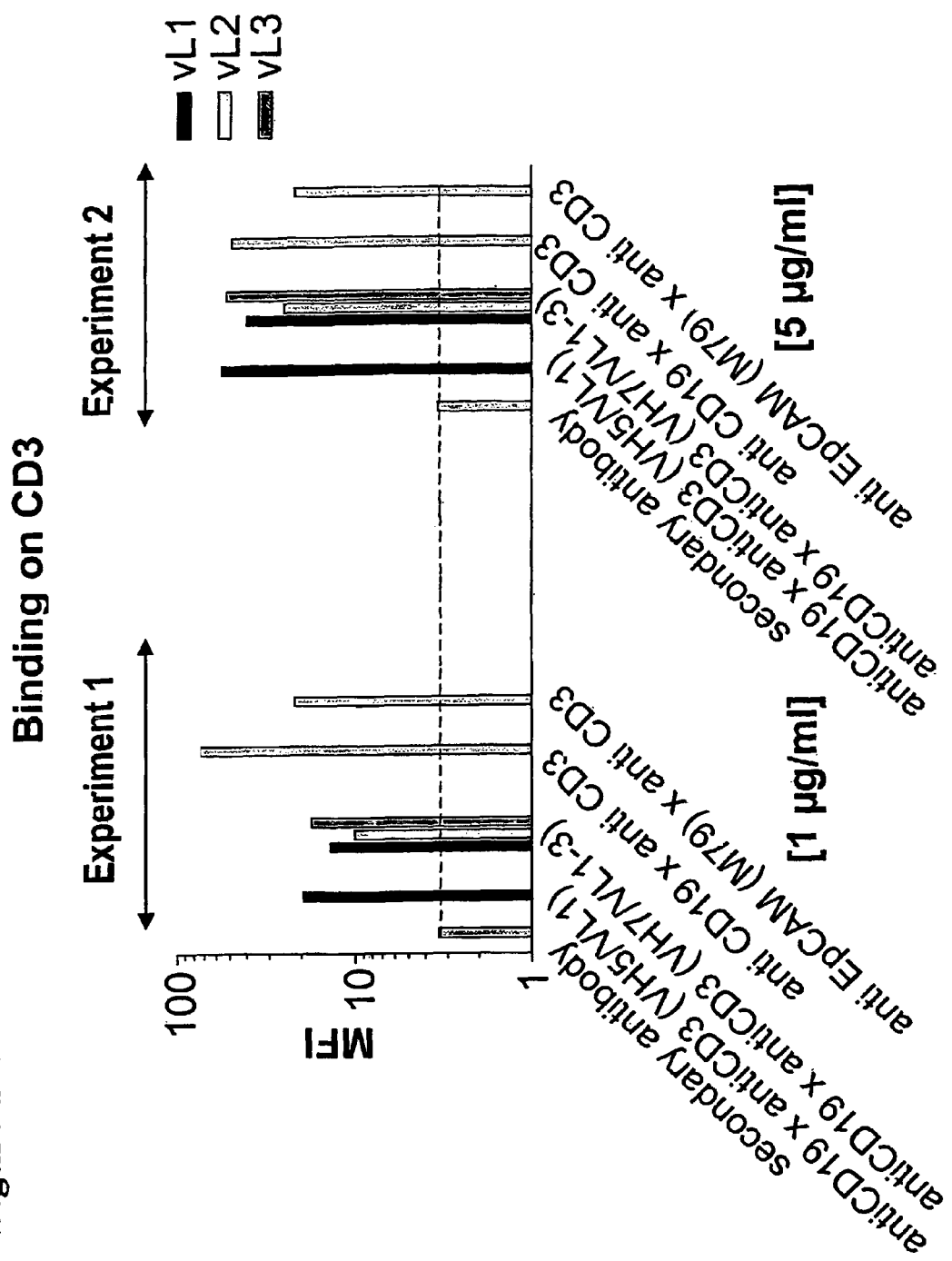

Binding of selected purified antibody constructs comprising anti-CD19 and anti-CD3 was detected as described above in Example 2 at various concentrations. In the CD3 binding assay, the negative control secondary antibody (anti-His, FITC-conjugated), which was incubated with CD3 positive cells, showed a MFI of about 2.5 and the positive control deimmunized antiCD19×anti-CD3 bispecific single chain antibody of about 70 at 1 μg/ml concentration and 50 at 5 μg/ml concentration (FIG. 12A). At the concentration of 1 μg/ml, the anti-CD3 (VH5/VL1) (SEQ ID NO.:190), anti-CD3 (VH7/VL1) (SEQ ID NO.:196), anti-CD3 (VH7/VL2) (SEQ ID NO.:198) and anti-CD3 (VH7/VL3) (SEQ ID NO.: 200) deimmunized bispecific antibodies showed MFI values of 10-20; anti-CD3 (VH5/VL1) (SEQ ID NO.:190) having the highest (20). At 5 μg/ml anti-CD3 (VH7/VL2) (SEQ ID NO.:198) reached a MFI of 25, while anti-CD3 (VH7/VL1) (SEQ ID NO.:196), anti-CD3 (VH7/VL3) (SEQ ID NO.:200) and anti-CD3 (VH5/VL1) (SEQ ID NO.:190) had an MFI of at least 40 thus, showing the same binding efficacy than the non-deimmunized positive control. At a concentration of 5 μg/ml the strongly binding constructs with deimmunized anti-CD3 part VH5/VL1 (SEQ ID NO.:190), VH7/VL1 (SEQ ID NO.:196), VH7/VL2 (SEQ ID NO.:198), VH7/VL3 (SEQ ID NO.:200) bound to CD3 as well as the non-deimmunized anti-CD19×anti-CD3 (SEQ ID NO.:204).

Figure 12B:
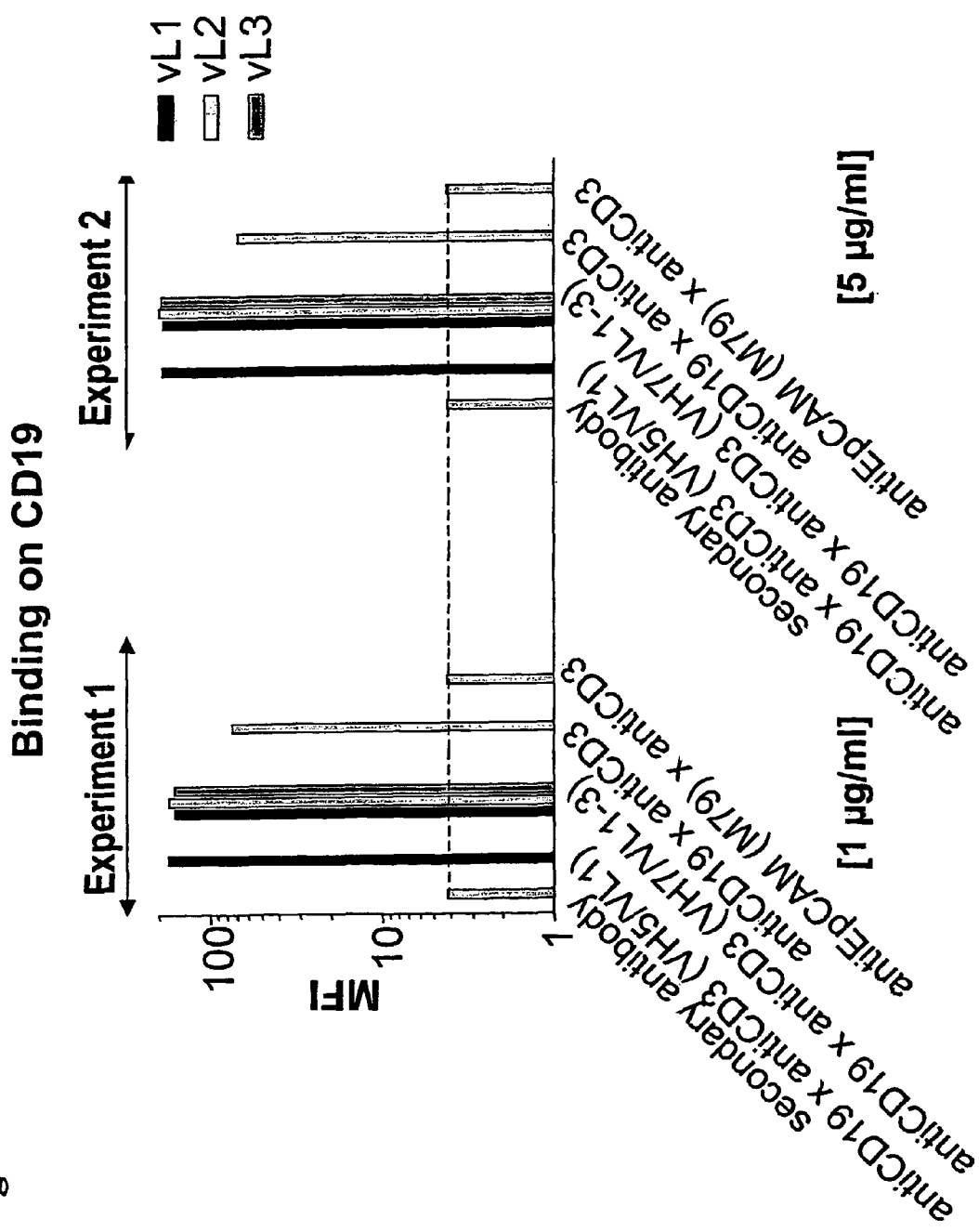

All the antibody constructs bound to CD19 with a high efficacy, which was at about 200 MFI, while non-deimmunized anti-CD19×anti-CD3 construct (SEQ ID NO.:204) showed 80 MFI. No differences were observed for CD19 binding at the tested concentrations for the different constructs (FIG. 12B).

EXAMPLE 5

Cytotoxicity Assays

Anti-CD19×anti-CD3 mediates T cell dependent cytotoxicity to CD19-positive target cells. This was analyzed in vitro for the determination of the biological potency of anti-CD19×anti-CD3.

For this purposes fluorescence labeled CD19-positive NALM-6 target cells were incubated with isolated PBMC of random donors or CB15 T-cells (standardized T-cell line) as effector cells in the presence of anti-CD19×anti-CD3. After incubation for 4 h at 37° C. in a humidified incubator, the release of the fluorescent dye from the target cells into the supernatant is determined in a spectrofluorimeter. Target cells incubated without anti-CD19×anti-CD3 and target cells totally lysed by the addition of saponin at the end of the incubation serve as negative and positive controls, respectively. The specific cytotoxicity mediated at a certain anti-CD19×anti-CD3 concentration can be calculated with the following formula:

$$\text{Specific Cytotoxicity } [\%] = \frac{RFU(\text{Sample}) - \text{Mean } RFU(\text{control})}{\text{Mean } RFU(\text{total lysis}) - \text{Mean } RFU(\text{control})} \times 100$$

The dose response was analyzed from 0.4 pg/ml anti-CD19×anti-CD3 to 100 ng/ml anti-CD19×anti-CD3 to specify the EC50 value. Although the EC50 value describes the biological potency of anti-CD19×anti-CD3, the absolute value will vary significantly depending on the source of the effector cells. Thus a relative potency is calculated in comparison to an anti-CD19×anti-CD3 reference material based on the following formula:

$$\text{Relative Potency} = \frac{EC50 \text{ Sample}}{EC50 \text{ Reference}}$$

The cytotoxic activities of the constructs comprising anti-CD19 and deimmunized anti-CD3 are shown in FIG. 13. Purified non-deimmunized anti-CD19×anti-CD3 was used as control. The EC50 values of the deimmunized constructs were at a range of 21.9-81.6 pg/ml while the EC50 value of the non-deimmunized anti-CD19×anti-CD3 construct was 22.7 pg/ml. Thus, all deimmunized constructs revealed EC 50 values comparable to the non-deimmunized molecule.

EXAMPLE 6

T-Cell Proliferation Assay

Twenty healthy donors were selected for screening in T cell assays based on HLA-DR typing (Table 12). This enables the screening of peptides in the T cell assay against greater than 80% of DR alleles expressed in the world population.

TABLE 12

HLA DR haplotypes of 20 healthy donors used to test the immunogenicity of peptides obtained from deimmunized and non-deimmunized anti-CD3 scAb.

| | HLA DR Allotype |
|---|---|
| 1 | DRB1*07, DRB1*15, DRB4*01, DRB5 |
| 2 | DRB1*03, DRB1*04, DRB3, DRB4*01 |
| 3 | DRB1*04, DRB1*07 and DRB4*01 |
| 4 | DRB1*07, DRB1*11, DRB4*01 |
| 5 | DRB1*04, DRB1*07, DRB4*01 |
| 6 | DRB1*01, DRB1*04, DRB4*01 |
| 7 | DRB1*03, DRB1*07, DRB3, DRB4*01 |
| 8 | DRB1*07, DRB1*11, DRB3, DRB4*01 |
| 9 | DRB1*12. DRB1*15, DRB3, DRB5 |
| 10 | DRB1*01, DRB1*09, DRB4*01 |
| 11 | DRB1*03, DRB1*15, DRB3, DRB5 |
| 12 | DRB1*10, DRB1*13, DRB3 |
| 13 | DRB1*03, DRB1*15, DRB3, DRB5 |
| 14 | DRB1*04, DRb1*15, DRB4*01, DRB5 |
| 15 | DRB1*04, DRB1*13, DRB3, DRB4*01 |
| 16 | DRB1*01, DRB1*13, DRB3 |
| 17 | DRB1*01, DRB1*04, DRB4*01 |
| 18 | DRB1*07, DRB1*13, DRB3, DRB4*01 |
| 19 | DRB1*07, DRB1*16, DRB4*01, DRB5 |
| 20 | DRB1*04, DRB1*15, DRB4*01, DRB5 |

6.1 T-Cell Proliferation Assay

Peptides were obtained from Pepscan (Netherlands) at a purity of greater than 90%. Peripheral blood mononuclear cells (PBMC) from the 20 selected healthy donors (Table 12) were used to screen individual peptides in triplicate wells at 1 and 5 μM. Two positive control peptides (C32 and C49) and keyhole limpet hemocyanin (KLH) were included in the assay. After 7 days incubation of cells and peptides, an 18 hour pulse with 3H-thymidine at 1 μCi/well was used to assess T cell proliferation. These data are expressed as stimulation index where:

Stimulation Index=CPM of test peptide/CPM of untreated control

A T cell epitope is defined as a peptide giving a stimulation index (SI) greater than 2. The results from two independent runs indicated that 5 of the 22 MHC binding peptides in the non-deimmunized anti-CD3 sequence had the capacity to induce human T cell proliferation (SI>2). In contrast, none of the corresponding deimmunized molecules induced T cell proliferation. Table 13 summarizes the T cell proliferation assay results showing Mean SI values of 2 independent runs.

The data also showed a concentration dependent effect whereby each of the non-deimmunized binding molecules showed SI's>2 in only one of the two concentrations (1 μm or 5 μm) used. The difference in response at different concentrations is explained by the fact that individual peptides will have optimum concentrations at which they induced T cell proliferation. If this concentration is exceeded, then proliferation can drop off (high peptide concentrations can have an inhibitory effect on T cell proliferation). This explains why, in some instances, proliferation is seen at the lower concentration and not at the higher. From experience, T cell proliferation will be observed at one or two of the peptide concentrations used if a peptide contains a T cell epitope. These data demonstrated that deimmunization had successfully removed T cell epitopes from anti-CD3 (VH5/VL2) (SEQ ID NO.:19) and anti-CD3 (VH7/VL2) (SEQ ID NO.:25). The fact that about 75% of MHC binding peptides from the non-deimmunized anti-CD3 sequence did not induce T cell proliferation can be explained either by tolerance of the human immune system to these peptides or an inability of the human T cell repertoire to recognise these particular peptides.

TABLE 13

Summary of data comparing positive (SI > 2) mouse peptides and corresponding deimmunized peptides.

| Peptide Region | Allotype | Concentration (μM) | Non-deimmunized Anti-CD3 Mean SI | Deimmunized Anti-CD3 Mean SI |
|---|---|---|---|---|
| 6-20 | 5 | 5 | 2.51 | 0.77 |
| 74-86 | 5 | 1 | 2.52 | 0.97 |
| | | | | 0.96 |
| 90-102 | 5 | 5 | 2.21 | 0.56 |
| | | | | 1.38 |
| 90-102 | 6 | 5 | 2.24 | 0.90 |
| | | | | 0.82 |
| 90-102 | 11 | 5 | 2.23 | 0.83 |
| | | | | 0.78 |
| 162-174 | 5 | 1 | 3.82 | 0.59 |
| 216-230 | 10 | 1 | 2.12 | 1.03 |

EXAMPLE 7

Homology Alignment of Anti-CD3 (VH5), Anti-CD3 (VH7), Anti-CD3 (VH2) and Anti-CD3 (VH3) with the Non-Deimmunized Anti-CD3 VH The variable heavy region of the non-deimmunized CD3 antibody, VH5 (SEQ ID NO.:74), VH7 (SEQ ID NO.:76), VH2 (SEQ ID NO.:70) and VH3 (SEQ ID NO.:72) were aligned using the AlingnX program of Vector NTI Advance (Informax, Inc., USA). The Clustal W algorithm used is described in Nucleic Acid Research, 22 (22): 4673-4860, 1994. The alignment is shown in FIG. 14. From the alignment can be seen that the variable regions VH5 and VH7, which show surprisingly good binding have the sequence ASGYTF (SEQ ID NO: 233) at the transition region of framework 1 to CDR1. Furthermore, the VH regions showing no binding (VH2 (SEQ ID NO.:70) and VH3 (SEQ ID NO.:72)) comprise the sequence ASGYTA (SEQ ID NO: 411) at the transition of framework 1 to CDR1. Thus, for obtaining a construct having reduced propensity to generate T cell epitopes and binding to CD3, the construct has to comprise the sequence ASGYTF (SEQ ID NO: 233) at the transition of framework 1 to CDR1. Surprisingly, the variable heavy regions binding to CD3 and showing reduced propensity to generate T cell epitopes comprising the above-mentioned sequence ASGYTF (SEQ ID NO: 233) show good binding.

EXAMPLE 8

Cloning of Constructs Comprising Deimmunized Anti-CD3 and Anti-EpCAM

In order to demonstrate that the deimmunized anti-CD3 polypeptide of the invention can be a part of a functional construct with other targets, a number of bispecific constructs comprising deimmunized anti-CD3 (VH5/VL2) (SEQ ID NO.:19) and different anti-EpCAM single chain antibodies (3-1 (SEQ ID NO.:137, 139), 3-5 (SEQ ID NO.:141, 143), 4-1 (SEQ ID NO.:145, 147), 4-7 (SEQ ID NO.:149, 151), 5-10 (SEQ ID NO.:133, 135)) were generated.
8.1 Cloning of C-Terminal EpCAM Binders Comprising Deimmunized Anti-CD3 Part (SEQ ID NOs.: 30, 31, 32, 33, 34, 35, 36, 37, 38 and 39)
8.1.1 Amplification of the Deimmunized Anti-CD3 From the Anti-CD19×Anti-CD3 (VH5/VL2) Construct (SEQ ID NO.: 192)
The N-terminal deimmunized anti-CD3(VH5/VL2) was obtained by PCR using the deimmunized (CD19×anti-CD3 (VH5/VL2) (SEQ ID NO:192) as template and the following primers (DI CD3 5-2 VH BsrGI AGGTGTACACTC-CGACGTCCAACTGGTGCAGTCAG (SEQ ID NO.:40), DI CD3 5-2 VL BspE1 AATCCGGATTTGATCTCCACCT-TGGTCCCG (SEQ ID NO.:41).
8.1.2. Cloning and Expression of the Deimmunized Anti-CD3×Anti-EpCAM Deimmunized Constructs in $VH_{cD3}$—$VL_{cD3}$×$VH_{EpCAM}$—$VL_{EpCAM}$ Orientation
The above mentioned PCR product containing the deimmunized anti-CD3 was cleaved with the restriction enzymes BsrG1 and BspE1 and subsequently cloned into the bluescript KS vector (Stratagene, La Jolla, Calif.), containing the amino acid sequence of an eukaryotic secretory signal (leader peptide) as a EcoRI/BsrGI-fragment. After cleavage of this construct with EcoRI and BspE1 the resulting DNA fragment comprising the respective anti-CD3 scFv with the leader peptide was cloned into a EcoRI/BspEI cleaved plasmid containing the anti EpCAM scFv 3-1; 4-7, or 5-10 in C-terminal position in pEF-DHFR-vector. After confirmation of the sequence coding for the bispecific single chain by sequencing (Sequiserve, Vaterstetten) the plasmid was transfected into DHFR deficient CHO cells for eukaryotic expression. Eukaryotic protein expression in DHFR deficient CHO cells was performed as described in Kaufmann R. J. (1990) Methods Enzymol. 185, 537-566).
8.1.3. Cloning and Expression of the Deimmunized Anti-CD3×Anti-EpCAM Constructs in $VH_{cD3}$—$VL_{cD3}$×$VL_{EpCAM}$-$VH_{EpCAM}$ Orientation
Anti-EpCAM 4-7 in VL-VH orientation containing the 15 amino acid standard linker (SEQ ID NO.:168) was obtained by PCR. The 4-7 VH region and the 4-7 VL region were separately amplified by the following primers (4-7 VL: 4-7 VL BspE1 FOR CTGAAATCCGGAGGTGGTGGATC-CGAGCTCGTGATGACCCAGACTCC (SEQ ID NO.:117), 4-7 VL GS15 REV GGAGCCGCCGCCGCCAGAAC-CACCA CCACCTTTGATCTCAAGCTTGGTCCCC (SEQ ID NO.:118); 4-7 VH: 4-7 VH GS15 FOR GGCGGCGGCG-GCTCCGGTGGTGGTGGTTCTGAGGTG-CAGCTGCTCGAGCAG (SEQ ID NO.:42), 4-7 VH SalI REV TTTTAAGTCGACCTAATGATGATGAT-GATGATGTGAGGAGACGGTGACCGTGG (SEQ ID NO.:43)). Overlapping complementary sequences introduced into the PCR products were used to form the coding sequence of a 15-amino acid $(G_4S_1)_3$ (single-letter amino acid code) linker (standard linker) (SEQ ID NO.:168) during the subsequent fusion PCR. This amplification step was performed with the primer pair 4-7 VL BspE1 FOR and 4-7 VH SalI REV (SEQ ID Ns. 42 and 43).
Anti-EpCAM 5-10 in VL-VH orientation containing the 15 amino acid standard $((G_4S_1)_3)$ linker was obtained by PCR. The 5-10 VH region and the 5-10 VL region were separately amplified by the following primers (5-10 VL: 5-10 VL BspE1 FOR CTGAAATCCGGAGGTGGTGGATC-CGAGCTCGTGATGACACAGTCTCCAT (SEQ ID NO.:44), 5-10 VL GS15 REV GGAGCCGCCGCCGCCA-GAACCACCACCACCTTTGATCTCAAGCT-TGGTCCCAG; (SEQ ID NO.:45) 5-10 VH: 5-10 VH GS15 FOR GGCGGCGGCGGCTCCGGTGGTGGTGGT-TCTGAGGTGCAGCTGCTCGAGC (SEQ ID NO.:46), 5-10 VH SalI REV TTTTAAGTCGACCTAATGATGAT-GATGATGATGTGAGGAGACGGTGACCGTGG (SEQ ID NO.:47). Overlapping complementary sequences introduced into the PCR products were used to form the coding sequence of a 15-amino acid $(G_4S_1)_3$ (single-letter amino acid code) linker (standard linker) (SEQ ID NO.:168) during the subsequent fusion PCR. This amplification step was performed with the primer pair 5-10 VL BspE1 FOR and 5-10 VH SalI REV.
The PCR products 5-10 VL-VH and 4-7 VL-VH) were cloned into the pEF-DHFR vector comprising anti-CD3 construct (VH5/VL2). After confirmation of the sequence coding for the bispecific single chain by sequencing the plasmid was transfected into DHFR deficient CHO cells for eukaryotic expression. Eukaryotic protein expression in DHFR deficient CHO cells was performed as described in Kaufmann R. J. (1990) Methods Enzymol. 185, 537-566).
8.1.4. Binding of the Deimmunized Anti-CD3×Anti-EpCAM Constructs to EpCAM and CD3
Binding of the bispecific single chain molecules with anti-CD3 part in N-terminal orientation to EpCAM and CD3 were confirmed by FACS analyses. For that purpose the EpCAM positive human gastric cancer cell line Kato III (ATCC HTB-103) was used. Binding of the anti-CD3 part was demonstrated on Jurkat cells (ATCC TIB 152).

Cells were cultured according to the recommendations of the supplier and a number of 200000 cells was incubated with 10 µg/ml of the construct in 50 µl PBS with 2% FCS (fetal calf serum). The binding of the construct was detected with an anti-His antibody (Penta-His Antibody, obtained from Qiagen, Hilden, FRG) at 2 µg/ml in PBS with 2% FCS. As a second step R-Phycoerythrin-conjugated affinity purified F(ab')$_2$ derived from goat anti-mouse IgG, diluted 1:100 in 50 µl PBS with 2% FCS (Dianova, Hamburg, FRG) was used. The samples were measured on a FACSscan (BD biosciences, Heidelberg, FRG).

Results of FACS analysis are shown in FIG. 15. All constructs comprising deimmunized anti-CD3 part showed stronger binding than the non-deimmunized anti-EpCAM (M79)×anti-CD3 bispecific single-chain antibody on EpCAM positive Katolil cells.

8.2 Cloning of N-Terminal EpCAM Binders Comprising Deimmunized Anti-CD3 Part
8.2.1 Cloning of the Anti-EpCAM×Anti-CD3 Constructs
8.2.1.1 Cloning of Deimmunized 3-1×Anti-CD3 (VH5/VL2) Construct (SEQ ID NO.:48, 49):

Deimmunized construct 3-1×anti-CD3 (SEQ ID NO.: 48) was derived from non-deimmunized construct anti-EpCAM (3-1)×anti-CD3. The VH and VL regions of the anti-EpCAM antibody 3-1 are shown in SEQ ID NO.:137 and 139. The plasmids pEF-DHFR-3-1×anti-CD3 and pEF anti-CD3 (VH5/VL2) (SEQ ID NO.:192) were digested with BspEI and SalI (Biolabs) for the isolation of the vector and the insert anti-CD3 (VH5/VL2), respectively. The BspEI-SalI-digested vector was dephosphorylated and purified on 0.7% agarose gel, whereas the insert was purified on 1.5% agarose gel.

The purified fragment (BspEI-SalI) was subsequently cloned into the corresponding sites of the pEF-DHFR vector. The final 3-1×anti-CD3 (VH5/VL2) construct (SEQ ID NO.: 48, 49) was verified by restriction digests and by DNA sequencing of the entire insert.

Cloning of the Non-Deimmunized 3-1×Anti-CD3 Construct:

For the cloning of the 3-1×anti-CD3 (VH5/VL2) construct the corresponding non-deimmunized construct was generated as follows.

The C-terminal 3-1 in VH-VL orientation was obtained by PCR for the construction of non-deimmunized 3-1×anti-CD3 molecule. Fragments I and II comprising the 3-1 VH-VL in two parts were amplified by PCR using primer pairs me 91a (SEQ ID NO.: 53)/me 90 (SEQ ID NO.: 52) and me 83 (SEQ ID NO.: 50)/me 84 (SEQ ID NO.: 51), respectively. Hot Start PCR was done using the Expand High Fidelity System, of Roche Diagnostics. 20 cycles (94° C./30 sec; 60° C./1 min; 72° C./1 min) were used for amplification followed by one cycle of 3 min at 72° C.

PCR fragments I and II were subjected to electrophoresis on a 1.5% agarose gel. Fragments were mixed (1 ng of each) and used as a template for the next PCR reaction performed with primer pair me 91a (SEQ ID NO.: 53) and me 84 (SEQ ID NO.: 51) for amplification of fragment III comprising the entire 3-1. PCR was performed as described above, but with an annealing temperature of 68° C. Fragment III was purified on an agarose gel and digested with BsrGI and BspEI (Biolabs), purified and subsequently cloned into the corresponding sites of the pEF-DHFR-anti EpCAM (M79)×anti-CD3 construct. The cloned region was verified by restriction digests and by DNA-sequencing.

Sequences of the Primers used:

Me 83:
(SEQ ID NO.: 50)
5'- GGT TCT GGC GGC GGC GGC TCC GGT GGT GGT GGT

TCT GAG GTG CAG CTG CTC GA CAG TCT G -3'

Me 84:
(SEQ ID NO.: 51)
5'- GTG CTC CGG AGG AGA CGG TGA CCG TGG TCC CTT

GGC CCC AG -3'

Me 90:
(SEQ ID NO.: 52)
5'- CCG GAG CCG CCG CCG CCA GAA CCA CCA CCA CCT

TTG ATC TCA AGC TTG GTC CC-3'

Me 91a:
(SEQ ID NO.: 53)
5'- GGA TTG TAC A CTCC GA GCT CGT CAT GAC CCA GTC

TCC ATC TTA TCT TGC TGC -3'

8.2.1.2 Cloning of Deimmunized 3-5×Anti-CD3 (VH5/VL2) Construct (SEQ ID NO.:54, 55):

The C-terminal 3-5 in VH-VL orientation was obtained by PCR for the construction of 3-5×anti-CD3 molecule. The VH and VL regions of the anti-EpCAM antibody 3-5 are shown in SEQ ID NO.:141 and 143. The plasmids pEF-DHFR-3-5× anti-CD3 and pEF anti-CD3 (VH5/VL2) (SEQ ID NO.: 192) were digested with EcoRI and BspEI (Biolabs) for the isolation of the insert (3-5) and the vector respectively. The dephosphorylated vector (EcoRI and BspE1 digested) and the insert were purified by agarose gel-electrophoresis.

The purified fragment (EcoRI-BspEI) was subsequently cloned into the corresponding sites of the pEF-DHFR vector. The final 3-5×anti-CD3 (VH5/VL2) (SEQ ID NO.:54) construct was verified by restriction digests.

Cloning of the Non-Deimmunized 3-5×Anti-CD3 Construct:

For cloning of the 3-5×anti-CD3 (VH5/VL2) construct the corresponding non-deimmunized construct was generated as follows.

Fragments I and II comprising the 3-5 in two parts were amplified by PCR according to the conditions described for 3-1×anti-CD3 using primer pairs me 81 (SEQ ID NO.: 56)/me 90 (SEQ ID NO.: 52) and me 83 (SEQ ID NO.: 50)/me 84 (SEQ ID NO.: 51) respectively. Agarose gel fragments comprising PCR fragments I and II were reamplified with primer pair me 81 (SEQ ID NO.: 56) and me 84 (SEQ ID NO.: 51) for amplification of fragment III comprising the entire 3-5. PCR was performed as described above. Fragment III was purified on an agarose gel and digested with BssHII and BspEI (Biolabs), purified and subsequently cloned into the corresponding sites of the pEF-DHFR cloning vector. The cloned region was verified by restriction digests and by DNA-sequencing.

Sequence of the Me$_{81}$ Primer (Seq ID NO.:56):

Me 81:
5'- GGA TGC GCG CGA GCT CGT GAT GAC CCA GAC TCCA

CTC TCC-3'

8.2.1.3 Cloning of the Deimmunized 4-1×Anti-CD3 (VH5/VL2) Construct (SEQ ID NO.:57, 58):

The C-terminal 4-1 in VH-VL orientation was obtained by PCR for the construction of 4-1×anti-CD3 molecule. The VH and VL regions of the anti-EpCAM antibody 4-1 are shown in SEQ ID NO.:145 and 147. The plasmids pEF-DHFR-4-1× anti-CD3 and pEF anti-CD3 (VH5/VL2) (SEQ ID NO.:192) were digested with EcoRI and BspEI (Biolabs) for the isolation of the insert (4-1) and the vector respectively. The dephosphorylated vector (EcoRI and BspE1 digested) and the insert were purified by agarose gel-electrophoresis.

The purified fragment (EcoRI-BspEI) was subsequently cloned into the corresponding sites of the vector. The final construct 4-1×anti-CD3 (VH5/VL2) (SEQ ID NO.:57) was verified by restriction digests.

Cloning of the Non-Deimmunized 4-1×Anti-CD3 Construct:

For cloning of the 4-1×anti-CD3 (VH5/VL2) construct the corresponding non-deimmunized construct was generated as follows.

Fragments I and II comprising the 4-1 in two parts were amplified by PCR using primer pairs me 91a (SEQ ID NO.: 53)/me 90 (SEQ ID NO.: 452) and me 83 (SEQ ID NO.: 50)/me 84 (SEQ ID NO.: 51) with the above-mentioned conditions, respectively.

Agarose gel fragments comprising PCR fragments I and II were reamplified with primer pair me 92a (SEQ ID NO.: 59) and me 84 (SEQ ID NO.: 51) for amplification of fragment III comprising the entire 4-1. PCR was performed as described above but annealing was performed at 68° C. Fragment III was purified on an agarose gel and digested with BsrGI and BspEI (Biolabs), purified and subsequently cloned into the corresponding sites of the pEF-DHFR-anti EpCAM (M79) X anti-CD3 cloning vector construct. The cloned region was verified by restriction digests and by DNA-sequencing.
Sequence of the Me92a Primer (SEQ ID NO.: 59):

```
Me 92a:
5'- GGA TTG TAC A CTCC GA GCT CGT GAT GAC ACA
GTCTCC ATC CTC C-3'
```

8.1.2.4 Cloning of the Deimmunized 4-7×Anti-CD3 (VH5/VL2) Construct (SEQ ID NO.:60, 61).

The C-terminal 4-7 in VH-VL orientation was obtained by PCR for the construction of 4-7×anti-CD3. The VH and VL regions of the anti-EpCAM antibody 4-7 are shown in SEQ ID NO.:149 and 151. The plasmids pEF-DHFR-4-7×anti-CD3 and pEF anti-CD3 VH5/VL2 (SEQ ID NO.:192) were digested with EcoRI and BspEI (Biolabs) for the isolation of the insert (4-7) and the vector respectively. The de-phosphorylated vector (EcoRI and BspE1 digested) and the insert were purified by agarose gel-electrophoresis.

The purified fragment (EcoRI-BspEI) was subsequently cloned into the corresponding sites of the pEF-DHFR vector. The final construct 4-7×anti-CD3 (VH5/VL2) (SEQ ID NO.: 60) was verified by restriction digests.

Cloning of the Non-Deimmunized Construct 4-7×Anti-CD3:

For cloning of the 4-7×anti-CD3 (VH5/VL2) construct the corresponding non-deimmunized construct was generated as follows.

Fragments I and II comprising the 4-7 in two parts were amplified by PCR using primer pairs me 81 (SEQ ID NO.: 56)/me 90 (SEQ ID NO.:52) and me 83 (SEQ ID NO.:50)/me 84 (SEQ ID NO.:51) with the afore mentioned conditions, respectively. Agarose gel fragments comprising PCR fragments I and II were reamplified with primer pair me 81 (Seq ID NO.:56) and me 84 (Seq ID NO.:51) for amplification of fragment III comprising the entire 4-7 VH and VL chain. PCR was performed as described above. Fragment III was purified on an agarose gel and digested with BssHIII and BspEI (Biolabs), purified and subsequently cloned into the corresponding sites of the pEF-DHFR cloning vector. The cloned region was verified by restriction digests and by DNA-sequencing.

8.1.2.5 Cloning of the Deimmunized 5-10×Anti-CD3 (VH5/VL2) Construct (SEQ ID NO.: 62, 63):

The C-terminal 5-10 in VH-VL orientation was obtained by PCR for the construction of 5-10×anti-CD3 molecule. The VH and VL regions of the anti-EpCAM antibody 5-10 are shown in SEQ ID NO.:133 and 135. The plasmids pEF-DHFR-5-10×anti-CD3 and pEF anti-CD3 (VH5/VL2) (SEQ ID NO.:192) were digested with EcoRI and BspEI (Biolabs) for the isolation of the insert (5-10) and the vector respectively. The dephosphorylated vector (EcoRI and BspE1 digested) and the insert were purified by agarose gel-electrophoresis.

The purified fragment (EcoRI-BspEI) was subsequently cloned into the corresponding sites of the pEF-DHFR vector. The final construct 5-10×anti-CD3 (VH5/VL2) (SEQ ID NO.: 62) was verified by restriction digests and by DNA sequencing.

Cloning of the Non-Deimmunized 5-10×Anti-CD3 Construct:

For cloning the 5-10×anti-CD3 (VH5/VL2) construct the corresponding non-deimmunized construct was generated as follows.

Fragments I and II comprising the 5-10 in two parts were amplified by PCR using primer pairs me 92a (SEQ ID NO.: 59)/me 90 (SEQ ID NO.: 52) and me 83 (SEQ ID NO.: 50)/me 84 (SEQ ID NO.: 51) with the above mentioned conditions, respectively. Agarose gel fragments comprising PCR fragments I and II were reamplified with primer pair me 92a SEQ ID NO.: 59) and me 84 (SEQ ID NO.: 51) for amplification of fragment III comprising the entire 5-10. PCR was performed as described above but annealing was performed at 68° C. Fragment III was purified on an agarose gel and digested with BsrGI and BspEI (Biolabs), purified and subsequently cloned into the corresponding sites of the pEF-DHFR-anti EpCAM (M79)×anti-CD3 cloning vector. The cloned region was verified by restriction digests and by DNA-sequencing.

8.2.2 Expression of Anti EpCAM×Deimmunized-Anti-CD3 Molecules with Anti-EpCAM at the N-Terminal Position:

CHO-cells lacking DHFR gene were maintained in alpha MEM medium (Life Technologies, cat.no: 32561) supplemented with 10% fetal calf serum (Life Technologies, heat inactivated at 65° C. for 30 minutes) and with HT (Hypoxanthin and Thymidine; Life Technologies). The cells were transfected with pEF-DHFR-3-1×anti-CD3 (VH5/VL2) (SEQ ID NO.: 48) and pEF-DHFR-5-10×anti-CD3 (VH5/VL2) (SEQ ID NO.:62), using Lipofectamine 2000 Kit® (Invitrogen) according to the instructions provided by the Manufacturer. After 48 hrs. selection was performed in selection medium (alpha MEM medium containing heat inactivated 10% dialysed fetal calf serum (Life Technologies). After 3-4 weeks cell culture supernatant was collected and centrifuged at 4° C. for 10 minutes at 300 g to remove cells and cell debris. The supernatant containing the bispecific antibody was stored at −20° C. till further analysis.

8.2.3 Binding Assays of Bispecific Anti-EpCAM×Anti-CD3 Variants:

250000 Jurkat cells (for CD3 binding) and Kato cells (for EpCAM binding) were independently incubated with cell culture supernatants (50 µl) containing the bispecific construct (pEF-DHFR-3-1×anti-CD3 (VH5/VL2) (Nr.50, SEQ ID NO.: 48) and pEF-DHFR-5-10×anti-CD3 (VH5/VL2) (Nr.54) (SEQ ID NO.:62), respectively) for 45 min. at 4° C. Thereafter, the cells were washed twice in FACS buffer (phosphate-buffered saline containing 1% fetal calf serum (FCS) and 0.05% sodium azide) and incubated with mouse anti-His antibody (Dianova, DIA910) for 60 min. at 4° C. Washing steps were performed as above.

The cells were finally incubated either with goat anti-mouse Ig-FITC-conjugated antibody (BD 550003) or with anti-mouse IgG conjugated with PE (Sigma, P8547). After washing steps, 10000 events were analysed using FACS Calibur (B&D). The results of the binding assays are shown in FIG. 16. The constructs 3-1×anti-CD3 (VH5/VL2) (SEQ ID NO.:49) and 5-10×anti-CD3 (SEQ ID NO.:63) showed strong binding to CD3 on Jurkat cells and to CD19 on Kato cells.

EXAMPLE 8.3

Purification of Bispecific Anti EpCAM Constructs with Deimmunized Anti-CD3 Part

The constructs comprising a deimmunized anti-CD3 region and an EpCAM-specific region were purified with a two-step purification process including immobilized metal affinity chromatography (IMAC) and gel filtration. Metal affinity chromatography (IMAC) and gel filtration were carried out as demonstrated in example 3.2. A further high-resolution cation exchange chromatography was performed on a MiniS column (Amersham), equilibrated with 20 mM MES buffer pH 5.5. The sample was diluted 1:3 with the same buffer before loading to the column. Bound protein was eluted with a 0-30% gradient of 1 M NaCl in equilibration buffer. The eluted protein fractions were tested in the bioactivity assay. Table 14 shows the yields of the purified deimmunized EpCAM constructs. All the constructs could be efficiently produced. Surprisingly, the construct 5-10×anti-CD3 (VH5/VL2) (SEQ ID NO.:63) had an extremely good yield of 2200 µg/l.

TABLE 14

Yields of the deimmunized EpCAM constructs

| Construct | Yield of the monomer [µg purified protein per liter culture] |
|---|---|
| anti-CD3 (VH5/VL2) × 4-7 (SEQ ID NO.: 33) | 112.5 |
| 3-1 × anti-CD3 (VH5/VL2) (SEQ ID NO.: 49) | 87.5 |
| anti-CD3 (VH5/VL2) × 3-1 (SEQ ID NO.: 31) | 442.5 |
| 5-10 × anti-CD3 (VH5/VL2) (SEQ ID NO.: 63) | 2200 |
| anti-CD 3 (VH5/VL2) × 5-10 (SEQ ID NO.: 37) | 80 |

EXAMPLE 8.4

Cytotoxic Assays of the Bispecific Anti-EpCAM Constructs with Deimmunized Anti-CD3 Part In order to confirm the high bioactivity of the bispecific antibodies of the invention, a FACS based assay was carried out. CHO cells were transfected with epithelial cell adhesion molecule (EpCAM). A cell clone derived from this transfection, referred to as CHO-EpCAM cells, was used for the experiments.

For the cytotoxicity test, CHO-EpCAM ($1.5 \times 10^7$) cells were washed free of serum two times with PBS and incubated with PKH26 dye (Sigma-Aldrich Co.) according to the manufacturers instructions. After staining, cells were washed two times with RPMI/10% FCS.

Cells were counted and mixed with CB15 effector cells. The CD4-positive T cell clone CB15 was kindly provided by Dr. Fickenscher, University of Erlangen/Nuernberg, Germany. Cells were cultured as recommended by the suppliers. The resulting cell suspension contained 400.000 target and $2 \times 10^6$ effector cells per ml. 50 µl of the mixture was used per well in a 96 well round bottom plate.

Antibodies were diluted in RPMI/10% FCS to the required concentration and 50 µl of this solution was added to the cell suspension. A standard reaction was incubated for 16 h at 37° C./5% $CO_2$. Propidium iodide was added to a final concentration of 1 µg/ml. After 10 min of incubation at room temperature cells were analysed by FACS. PKH26 fluorescence was used for positive identification of target cells. Cytotoxicity was measured as ratio of PI positive over all target cells.

Sigmoidal dose response curves typically had R2 values > 0.97 as determined by Prism Software (GraphPad Software Inc., San Diego, USA). The results of the cytotoxic assays are shown in FIGS. 17 and 18.

EXAMPLE 8.5

Comparison of the Productivity of Bispecific Molecules Comprising an EpCAM Binding Part and a Deimmunized CD3 Binding Part in CHO Cells In order to determine the productivity of a deimmunized construct protein L ELISA was performed. The productivity data was calculated from batch cultures.

8.5.1 Cell Culture

CHO cell lines producing deimmunized (CHO-DHFR—) and non-deimmunized (CHO-DHFR- or CHO-K1) were cultivated in HyQ PF CHO LS medium+4 mM L-Glutamine in a $CO_2$ incubator at 37° C. and 5% $CO_2$. Cell numbers and viability were determined using Trypan Blue. Cell density was set to $1-2 \times 10^5$ cell/ml.

Cells were transferred to spinner flasks and thus adjusted to conditions of a stirred culture. Operational parameter settings were 80 rpm, 37° C. and 5% $CO_2$ with gassing in a $CO_2$ incubator. Culture volume was in the 100-500 ml-range and cell density at inoculation in the range of $1-2 \times 10^5$ cells/ml. As for the subcultivation in T-flasks, cultures were centrifuged and resuspended in fresh pre-warmed medium at each passage. Cell density was set to $1-2 \times 10^5$ cells/ml.

For analysis of productivity data (Table 15) cells were cultivated up to 14 days (d) without any medium addition or exchange. Cell numbers and viability were determined daily using Trypan blue stain. Product concentrations in the supernatant were analyzed by Protein L ELISA.

8.5.2 Protein L ELISA

Quantitative binding of the bispecific molecules was carried out with rProtein L-coated microtiter plates. rProtein L is a recombinant form of the immunoglobulin-binding Protein L produced by *Peptostreptococcus magnus*. It has four binding domains and binds immunoglobulin through the light chain M. Bispecific molecules, which contain variable domains from two different light chains respectively parent antibodies, are also bound by rProtein L.

Microtiter plates were coated with rProtein L in PBS buffer (2 µg rProtein L/ml PBS buffer) overnight at 2-8° C. Following coating, remaining adsorption sites were blocked with of blocking buffer (2% BSA in PBS buffer). Then, the plates were frozen and stored at ≦18° C. Before use, the plates were thawed and washed with washing buffer (0.05% Tween 20 in PBS buffer) to remove the mixture of coating solution and blocking buffer.

Serial dilutions of cell-free cell culture supernatant in 1% BSA+0.01% Tween 20 in PBS (dilution buffer) were analyzed. Bispecific anti-EpCAM(M79)×anti-CD3 was used as positive control in comparable dilutions.

Incubation was performed overnight at 2-8° C.

After washing rabbit anti-mouse IgG (1:5,000 in dilution buffer) was added and incubated for 60 min at room temperature. Goat anti-rabbit IgG labeled with alkaline phosphatase was added (1:1,000 in dilution buffer; 60 min at room temperature) after washing. pNPP substrate solution was added and the reaction was stopped by addition of 3 M NaOH. Absorbance was measured with an ELISA reader at 405 nm (reference filter 492 nm).

TABLE 15

Productivity of an deimmunized anti-EpCAM construct

| Construct | | M79 × anti-anti-CD3 | 5-10 × anti-CD3 (VH5/VL2) |
|---|---|---|---|
| Basic cell line | | CHO-K1 | CHO-dhfr- | CHO-dhfr- |
| Specific productivity | | 0.2-0.6 pg/cell per day | 1-3 pg/cell per day | 15-20 pg/cell per day |
| Maximal cell density | | $3 \times 10^6$ c/ml | $1.2$-$1.8 \times 10^6$ c/ml | $1.5 \times 10^6$ c/ml |
| Doubling time | | 17-20 h | 25-30 h | 25-30 h |

Thus, the inventive 5-10×anti-CD3 (VH5/VL2) construct demonstrated much higher specific productivity (at least five times higher) than the prior art bispecific non-deimmunized EpCAM and CD3 binding antibody.

SEQUENCE LISTING (415 sequences)

SEQ ID NO: 1 - DNA, 729 bp, Artificial Sequence
  Description of Artificial Sequence: Synthetic construct
gatatcaaactgcagcagtcaggggctgaactggcaagacctggggcctcagtgaagatgtcctgcaagacttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcagtcgaaggtggaagtggaggttctggtggaagtggaggttcaggtggagtcgacgacattcagctgacccagtctccagcaatcatgtctgcatctccaggggagaaggtcaccatgacctgcagagccagttcaagtgtaagttacatgaactggtaccagcagaagtcaggcacctcccccaaaagatggatttatgacacatccaaagtggcttctggagtcccttatcgcttcagtggcagtgggtctgggacctcatactctctcacaatcagcagcatggaggctgaagatgctgccacttattactgccaacagtggagtagtaacccgctcacgttcggtgctgggaccaagctggagctgaaa

SEQ ID NO: 2 - protein, 243 aa, Artificial Sequence
  Description of Artificial Sequence: Synthetic construct
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 3 - protein, 18 aa, Artificial Sequence
  Description of Artificial Sequence: Synthetic peptide
GEGTSTGSGGSGGSGGAD

SEQ ID NO: 4 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 5 - protein, 243 aa, Artificial Sequence
  Description of Artificial Sequence: Synthetic construct
DVQLVQSGAEVKKPGASVKVSCKASGYTATRYTMHWVRQAPGQGLEWIGYINPSRGYTNYAQKLQGRVTMTTDTSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 6 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 7 - protein, 243 aa, Artificial Sequence
  Description of Artificial Sequence: Synthetic construct
DVQLVQSGAEVKKPGASVKVSCKASGYTATRYTMHWVRQAPGQGLEWIGYINPSRGYTNYAQKLQGRVTMTTDTSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 8 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 9 - protein, 243 aa, Artificial Sequence
  Description of Artificial Sequence: Synthetic construct
DVQLVQSGAEVKKPGASVKVSCKASGYTATRYTMHWVRQAPGQGLEWIGYINPSRGYTNYAQKLQGRVTMTTDTSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 10 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacctgcaaatgaacagcctgaaaactgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 11 - protein, 243 aa, Artificial Sequence
  Description of Artificial Sequence: Synthetic construct
DVQLVQSGAEVKKPGASVKVSCKASGYTATRYTMHWVRQAPGQGLEWIGYINPSRGYTNYAQKLQGRVTMTTDTSTSTAYLQMNSLKTEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 12 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacctgcaaatgaacagcctgaaaactgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 13 - protein, 243 aa, Artificial Sequence
  Description of Artificial Sequence: Synthetic construct
DVQLVQSGAEVKKPGASVKVSCKASGYTATRYTMHWVRQAPGQGLEWIGYINPSRGYTNYAQKLQGRVTMTTDTSTSTAYLQMNSLKTEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 14 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacctgcaaatgaacagcctgaaaactgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 15 - protein, 243 aa, Artificial Sequence
  Description of Artificial Sequence: Synthetic construct
DVQLVQSGAEVKKPGASVKVSCKASGYTATRYTMHWVRQAPGQGLEWIGYINPSRGYTNYAQKLQGRVTMTTDTSTSTAYLQMNSLKTEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 16 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 17 - protein, 243 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 18 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 19 - protein, 243 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 20 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 21 - protein, 243 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 22 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 23 - protein, 243 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 24 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 25 - protein, 243 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 26 - DNA, 729 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 27 - protein, 243 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 28 - DNA, 20 bp, Artificial Sequence
  Description of Artificial Sequence: Synthetic primer
cctcagacagtggttcaaag

SEQ ID NO: 29 - DNA, 18 bp, Artificial Sequence
  Description of Artificial Sequence: Synthetic primer
agccgccacgtgggcctc

SEQ ID NO: 30 - DNA, 1473 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgaggtgcagctgctcgagcagtctggagctgagctggtgaaacctggggcctcagtgaagatatcctgcaaggcttctggatacgccttcactaactactggctaggttgggtaaagcagaggcctggacatggacttgagtggattggagatcttttccctggaagtggtaatactcactacaatgagaggttcaggggcaaagccacactgactgcagacaaatcctcgagcacagcctttatgcagctcagtagcctgacatctgaggactctgctgtctatttctgtgcaagattgaggaactgggacgaggctatggactactggggccaagggaccacggtcaccgtctcctcaggtggtggtggttctggcggcggcggctccggtggtggtggttctgagctcgtcatgacccagtctccatcttatcttgctgcatctcctggagaaaccattactattaattgcagggcaagtaagagcattagcaaatatttagcctggtatcaagagaaacctgggaaaactaataagcttcttatctactctggatccactttgcaatctggaattccatcaaggttcagtggcagtggatctggtacagatttcactctcaccatcagtagcctggagcctgaagattttgcaatgtattactgtcaacagcataatgaatatccgtacacgttcggaggggggaccaagcttgagatcaaa

SEQ ID NO: 31 - protein, 491 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELVKPGASVKISCKASGYAFTNYWLGWVKQRPGHGLEWIGDLFPGSGNTHYNERFRGKATLTADKSSSTAFMQLSSLTSEDSAVYFCARLRNWDEAMDYWGQGTTVTVSSGGGGSGGGGSGGGGSELVMTQSPSYLAASPGETITINCRASKSISKYLAWYQEKPGKTNKLLIYSGSTLQSGIPSRFSGSGSGTDFTLTISSLEPEDFAMYYCQQHNEYPYTFGGGTKLEIK

SEQ ID NO: 32 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 33 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 34 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 35 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 36 - DNA, 1491 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaa

SEQ ID NO: 37 - protein, 497 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK

SEQ ID NO: 38 - DNA, 1491 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctca

SEQ ID NO: 39 - protein, 497 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 40 - DNA, 35 bp, Artificial Sequence
  Description of Artificial Sequence: Synthetic primer
aggtgtacactccgacgtccaactggtgcagtcag

SEQ ID NO: 41 - DNA, 30 bp, Artificial Sequence
  Description of Artificial Sequence: Synthetic primer
aatccggatttgatctccaccttggtcccg

SEQ ID NO: 42 - DNA, 51 bp, Artificial Sequence
  Description of Artificial Sequence: Synthetic primer
ggcggcggcggctccggtggtggtggttctgaggtgcagctgctcgagcag

SEQ ID NO: 43 - DNA, 53 bp, Artificial Sequence
  Description of Artificial Sequence: Synthetic primer
ttttaagtcgacctaatgatgatgatgatgatgtgaggagacggtgaccgtgg

SEQ ID NO: 44 - DNA, 49 bp, Artificial Sequence
  Description of Artificial Sequence: Synthetic primer
ctgaaatccggaggtggtggatccgagctcgtgatgacacagtctccat

SEQ ID NO: 45 - DNA, 53 bp, Artificial Sequence
  Description of Artificial Sequence: Synthetic primer
ggagccgccgccgccagaaccaccaccacctttgatctcaagcttggtcccag

SEQ ID NO: 46 - DNA, 49 bp, Artificial Sequence
  Description of Artificial Sequence: Synthetic primer
ggcggcggcggctccggtggtggtggttctgaggtgcagctgctcgagc

SEQ ID NO: 47 - DNA, 53 bp, Artificial Sequence; identical to SEQ ID NO: 43
  Description of Artificial Sequence: Synthetic primer

SEQ ID NO: 48 - DNA, 1518 bp, Artificial Sequence
  Description of Artificial Sequence: Synthetic construct
atgggatggagctgtatcatcctcttcttggtagcaacagctacaggtgtacactccgagctcgtcatgacccagtctccatcttatcttgctgcatctcctggagaaaccattactattaattgcagggcaagtaagagcattagcaaatatttagcctggtatcaagagaaacctgggaaaactaataagcttcttatctactctggatccactttgcaatctggaattccatcaaggttcagtggcagtggatctggtacagatttcactctcaccatcagtagcctggagcctgaagattttgcaatgtattactgtcaacagcataatgaatatccgtacacgttcggaggggggaccaagcttgagatcaaaggtggtggtggttctggcggcggcggctccggtggtggtggttctgaggtgcagctgctcgagcagtctggagctgagctggtgaaacctggggcctcagtgaagatatcctgcaaggcttctggatacgccttcactaactactggctaggttgggtaaagcagaggcctggacatggacttgagtggattggagatcttttccctggaagtggtaatactcactacaatgagaggttcaggggcaaagccacactgactgcagacaaatcctcgagcacagcctttatgcagctcagtagcctgacatctgaggactctgctgtctatttctgtgcaagattgaggaactgggacgaggctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 49 - protein, 506 aa, Artificial Sequence
  Description of Artificial Sequence: Synthetic construct
MGWSCIILFLVATATGVHSELVMTQSPSYLAASPGETITINCRASKSISKYLAWYQEKPGKTNKLLIYSGSTLQSGIPSRFSGSGSGTDFTLTISSLEPEDFAMYYCQQHNEYPYTFGGGTKLEIKGGGGSGGGGSGGGGSEVQLLEQSGAELVKPGASVKISCKASGYAFTNYWLGWVKQRPGHGLEWIGDLFPGSGNTHYNERFRGKATLTADKSSSTAFMQLSSLTSEDSAVYFCARLRNWDEAMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 50 - DNA, 60 bp, Artificial Sequence
  Description of Artificial Sequence: Synthetic primer
ggttctggcggcggcggctccggtggtggtggttctgaggtgcagctgctcgacagtctg

SEQ ID NO: 51 - DNA, 41 bp, Artificial Sequence
  Description of Artificial Sequence: Synthetic primer
gtgctccggaggagacggtgaccgtggtcccttggccccag

SEQ ID NO: 52 - DNA, 53 bp, Artificial Sequence
  Description of Artificial Sequence: Synthetic primer
ccggagccgccgccgccagaaccaccaccacctttgatctcaagcttggtccc

SEQ ID NO: 53 - DNA, 52 bp, Artificial Sequence
  Description of Artificial Sequence: Synthetic primer
ggattgtacactccgagctcgtcatgacccagtctccatcttatcttgctgc

SEQ ID NO: 54 - DNA, 1560 bp, Artificial Sequence
  Description of Artificial Sequence: Synthetic construct
atgggatggagctgtatcatcctcttcttggtagcaacagctacaggtgtacactccgcgcgcgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggtaaggcctgggacttcagtgaagctgtcctgcaaggcttctggctacaccttcacaagctatggtttaagctgggtgaagcagagaactggacagggccttgagtggattggagaggtttatcctagaattggtaatgcttactacaatgagaagttcaagggcaaggccacactgactgcagacaaatcctccagcacagcgtccatggagctccgcagcctgacatctgaggactctgcggtctatttctgtgcaagacggggatcctacggtagtaactacgactggtacttcgatgtctggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 55 - protein, 520 aa, Artificial Sequence
  Description of Artificial Sequence: Synthetic construct
MGWSCIILFLVATATGVHSARELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELVRPGTSVKLSCKASGYTFTSYGLSWVKQRTGQGLEWIGEVYPRIGNAYYNEKFKGKATLTADKSSSTASMELRSLTSEDSAVYFCARRGSYGSNYDWYFDVWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 56 - DNA, 40 bp, Artificial Sequence
  Description of Artificial Sequence: Synthetic primer
ggatgcgcgcgagctcgtgatgacccagactccactctcc

SEQ ID NO: 57 - DNA, 1545 bp, Artificial Sequence
  Description of Artificial Sequence: Synthetic construct
atgggatggagctgtatcatcctcttcttggtagcaacagctacaggtgtacactccgagctcgtgatgacacagtctccatcctccctgagtgtgtcagcaggagagaaggtcactatgagctgcaagtccagtcagagtctgttaaacagtggaaatcaaaagaactacttggcctggtaccagcagaaaccagggcagcctcctaaactgttgatctacggggcatccactagggaatctggggtccctgatcgcttcacaggcagtggatctggaacagatttcactctcaccatcagcagtgtgcaggctgaagacctggcagtttattactgtcagaatgattatagttatccgtacacgttcggaggggggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggttaagcagaggcctggacatggacttgaatgggttggagatattttccctggaagtggtaatgctcactacaatgagaagttcaagggcaaagccacactgactgcagacaagtcctcgtacacagcctatatgcagctcagtagcctgacatctgaggactctgctgtctatttctgtgcaagattgcggaactgggacgaggctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 58 - protein, 515 aa, Artificial Sequence
  Description of Artificial Sequence: Synthetic construct
MGWSCIILFLVATATGVHSELVMTQSPSSLSVSAGEKVTMSCKSSQSLLNSGNQKNYLAWYQQKPGQPPKLLIYGASTRESGVPDRFTGSGSGTDFTLTISSVQAEDLAVYYCQNDYSYPYTFGGGTKLEIKGGGGSGGGGSGGGGSEVQLLEQSGAELVRPGTSVKISCKASGYAFTNYWLGWVKQRPGHGLEWVGDIFPGSGNAHYNEKFKGKATLTADKSSYTAYMQLSSLTSEDSAVYFCARLRNWDEAMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 59 - DNA, 44 bp, Artificial Sequence
  Description of Artificial Sequence: Synthetic primer
ggattgtacactccgagctcgtgatgacacagtctccatcctcc

SEQ ID NO: 60 - DNA, 1560 bp, Artificial Sequence
  Description of Artificial Sequence: Synthetic construct
atgggatggagctgtatcatcctcttcttggtagcaacagctacaggtgtacactccgcgcgcgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 61 - protein, 520 aa, Artificial Sequence
  Description of Artificial Sequence: Synthetic construct
MGWSCIILFLVATATGVHSARELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 62 - DNA, 1545 bp, Artificial Sequence
  Description of Artificial Sequence: Synthetic construct
atgggatggagctgtatcatcctcttcttggtagcaacagctacaggtgtacactccgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 63 - protein, 515 aa, Artificial Sequence
  Description of Artificial Sequence: Synthetic construct
MGWSCIILFLVATATGVHSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 64 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgaggtgcagctgctcgagcagtctggagctgagctggtaaggcctgggacttcagtgaagctgtcctgcaaggcttctggctacaccttcacaagctatggtttaagctgggtgaagcagagaactggacagggccttgagtggattggagaggtttatcctagaattggtaatgcttactacaatgagaagttcaagggcaaggccacactgactgcagacaaatcctccagcacagcgtccatggagctccgcagcctgacatctgaggactctgcggtctatttctgtgcaagacggggatcctacggtagtaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 65 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELVRPGTSVKLSCKASGYTFTSYGLSWVKQRTGQGLEWIGEVYPRIGNAYYNEKFKGKATLTADKSSSTASMELRSLTSEDSAVYFCARRGSYGSNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 66 - DNA, 1491 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgaggtgcagctgctcgagcagtctggagctgagctggtaaggcctgggacttcagtgaagatatcctgcaaggcttctggatacgccttcactaactactggctaggttgggttaagcagaggcctggacatggacttgaatgggttggagatattttccctggaagtggtaatgctcactacaatgagaagttcaagggcaaagccacactgactgcagacaagtcctcgtacacagcctatatgcagctcagtagcctgacatctgaggactctgctgtctatttctgtgcaagattgcggaactgggacgaggctatggactactggggccaagggaccacggtcaccgtctcctcaggtggtggtggttctggcggcggcggctccggtggtggtggttctgagctcgtgatgacacagtctccatcctccctgagtgtgtcagcaggagagaaggtcactatgagctgcaagtccagtcagagtctgttaaacagtggaaatcaaaagaactacttggcctggtaccagcagaaaccagggcagcctcctaaactgttgatctacggggcatccactagggaatctggggtccctgatcgcttcacaggcagtggatctggaacagatttcactctcaccatcagcagtgtgcaggctgaagacctggcagtttattactgtcagaatgattatagttatccgtacacgttcggaggggggaccaagcttgagatcaaa

SEQ ID NO: 67 - protein, 497 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELVRPGTSVKISCKASGYAFTNYWLGWVKQRPGHGLEWVGDIFPGSGNAHYNEKFKGKATLTADKSSYTAYMQLSSLTSEDSAVYFCARLRNWDEAMDYWGQGTTVTVSSGGGGSGGGGSGGGGSELVMTQSPSSLSVSAGEKVTMSCKSSQSLLNSGNQKNYLAWYQQKPGQPPKLLIYGASTRESGVPDRFTGSGSGTDFTLTISSVQAEDLAVYYCQNDYSYPYTFGGGTKLEIK

SEQ ID NO: 68 - protein, 18 aa, Artificial Sequence
  Description of Artificial Sequence: Synthetic peptide
VEGGSGGSGGSGGSGGVD

SEQ ID NO: 69 - DNA, 357 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 70 - protein, 119 aa, Artificial Sequence
  Description of Artificial Sequence: Synthetic construct
DVQLVQSGAEVKKPGASVKVSCKASGYTATRYTMHWVRQAPGQGLEWIGYINPSRGYTNYAQKLQGRVTMTTDTSTSTAYMELSSLRSEDTATYYCARYYDDHYCLDYWGQGTTVTVSS

SEQ ID NO: 71 - DNA, 357 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacctgcaaatgaacagcctgaaaactgaggacactgcagtctattactgtgcaagatattatgatgatcattactgccttgactactggggccaaggcaccacggtcaccgtctcctca

SEQ ID NO: 72 - protein, 119 aa, Artificial Sequence
  Description of Artificial Sequence: Synthetic construct
DVQLVQSGAEVKKPGASVKVSCKASGYTATRYTMHWVRQAPGQGLEWIGYINPSRGYTNYAQKLQGRVTMTTDTSTSTAYLQMNSLKTEDTAVYYCARYYDDHYCLDYWGQGTTVTVSS

SEQ ID NO: 73 - DNA, 357 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 74 - protein, 119 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 75 - DNA, 357 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 76 - protein, 119 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 77 - DNA, 318 bp, Artificial Sequence
  Description of Artificial Sequence: Synthetic construct
gacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 78 - protein, 106 aa, Artificial Sequence
  Description of Artificial Sequence: Synthetic construct
DIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 79 - DNA, 318 bp, Artificial Sequence
  Description of Artificial Sequence: Synthetic construct
gacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 80 - protein, 106 aa, Artificial Sequence
  Description of Artificial Sequence: Synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 81 - DNA, 318 bp, Artificial Sequence
  Description of Artificial Sequence: Synthetic construct
gacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 82 - protein, 106 aa, Artificial Sequence
  Description of Artificial Sequence: Synthetic construct
DIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 83 - DNA, 30 bp, Artificial Sequence
  Description of Artificial Sequence: Synthetic construct
ggctacacctttactaggtacacgatgcac

SEQ ID NO: 84 - protein, 10 aa, Artificial Sequence
  Description of Artificial Sequence: Synthetic construct
GYTFTRYTMH

SEQ ID NO: 85 - DNA, 30 bp, Artificial Sequence
  Description of Artificial Sequence: Synthetic construct
ggctacaccgctactaggtacacgatgcac

SEQ ID NO: 86 - protein, 10 aa, Artificial Sequence
  Description of Artificial Sequence: Synthetic construct
GYTATRYTMH

SEQ ID NO: 87 - DNA, 30 bp, Artificial Sequence; identical to SEQ ID NO: 83
  Description of Artificial Sequence: Synthetic construct

SEQ ID NO: 88 - protein, 10 aa, Artificial Sequence
  Description of Artificial Sequence: Synthetic construct
GYTFTRYTMH

SEQ ID NO: 89 - DNA, 51 bp, Artificial Sequence
  Description of Artificial Sequence: Synthetic construct
tacattaatcctagccgtggttatactaattacaatcagaagttcaaggac

SEQ ID NO: 90 - protein, 17 aa, Artificial Sequence
  Description of Artificial Sequence: Synthetic construct
YINPSRGYTNYNQKFKD

SEQ ID NO: 91 - DNA, 51 bp, Artificial Sequence
  Description of Artificial Sequence: Synthetic construct
tacattaatcctagccgtggttatactaattacgcagacagcgtcaagggc

SEQ ID NO: 92 - protein, 17 aa, Artificial Sequence
  Description of Artificial Sequence: Synthetic construct
YINPSRGYTNYADSVKG

SEQ ID NO: 93 - DNA, 51 bp, Artificial Sequence
  Description of Artificial Sequence: Synthetic construct
tacattaatcctagccgtggttatactaattacgcacagaagttgcagggc

SEQ ID NO: 94 - protein, 17 aa, Artificial Sequence
  Description of Artificial Sequence: Synthetic construct
YINPSRGYTNYAQKLQG

SEQ ID NO: 95 - DNA, 30 bp, Artificial Sequence
  Description of Artificial Sequence: Synthetic construct
tattatgatgatcattactgccttgactac

SEQ ID NO: 96 - protein, 10 aa, Artificial Sequence
  Description of Artificial Sequence: Synthetic construct
YYDDHYCLDY

SEQ ID NO: 97 - DNA, 30 bp, Artificial Sequence
  Description of Artificial Sequence: Synthetic construct
agagccagttcaagtgtaagttacatgaac

SEQ ID NO: 98 - protein, 10 aa, Artificial Sequence
  Description of Artificial Sequence: Synthetic construct
RASSSVSYMN

SEQ ID NO: 99 - DNA, 30 bp, Artificial Sequence
  Description of Artificial Sequence: Synthetic construct
agagccagtcaaagtgtaagttacatgaac

SEQ ID NO: 100 - protein, 10 aa, Artificial Sequence
  Description of Artificial Sequence: Synthetic construct
RASQSVSYMN

SEQ ID NO: 101 - DNA, 21 bp, Artificial Sequence
  Description of Artificial Sequence: Synthetic construct
gacacatccaaagtggcttct

SEQ ID NO: 102 - protein, 7 aa, Artificial Sequence
  Description of Artificial Sequence: Synthetic construct
DTSKVAS

SEQ ID NO: 103 - DNA, 27 bp, Artificial Sequence
  Description of Artificial Sequence: Synthetic construct
caacagtggagtagtaacccgctcacg

SEQ ID NO: 104 - protein, 9 aa, Artificial Sequence
  Description of Artificial Sequence: Synthetic construct
QQWSSNPLT

SEQ ID NO: 105 - DNA, 357 bp, Artificial Sequence
  Description of Artificial Sequence: Synthetic construct
gatatcaaactgcagcagtcaggggctgaactggcaagacctggggcctcagtgaagatgtcctgcaagacttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactcccttgactactggggccaaggcaccactctcacagtctcctca

SEQ ID NO: 106 - protein, 119 aa, Artificial Sequence
  Description of Artificial Sequence: Synthetic construct
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSS

SEQ ID NO: 107 - DNA, 30 bp, Artificial Sequence
  Description of Artificial Sequence: Synthetic construct
tattatgatgatcattactcccttgactac

SEQ ID NO: 108 - protein, 10 aa, Artificial Sequence
  Description of Artificial Sequence: Synthetic construct
YYDDHYSLDY

SEQ ID NO: 109 - DNA, 357 bp, Artificial Sequence
  Description of Artificial Sequence: Synthetic construct
gatatcaaactgcagcagtcaggggctgaactggcaagacctggggcctcagtgaagatgtcctgcaagacttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctca

SEQ ID NO: 110 - protein, 119 aa, Artificial Sequence
  Description of Artificial Sequence: Synthetic construct
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 111 - DNA, 318 bp, Artificial Sequence
  Description of Artificial Sequence: Synthetic construct
gacattcagctgacccagtctccagcaatcatgtctgcatctccaggggagaaggtcaccatgacctgcagagccagttcaagtgtaagttacatgaactggtaccagcagaagtcaggcacctcccccaaaagatggatttatgacacatccaaagtggcttctggagtcccttatcgcttcagtggcagtgggtctgggacctcatactctctcacaatcagcagcatggaggctgaagatgctgccacttattactgccaacagtggagtagtaacccgctcacgttcggtgctgggaccaagctggagctgaaa

SEQ ID NO: 112 - protein, 106 aa, Artificial Sequence
  Description of Artificial Sequence: Synthetic construct
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 113 - DNA, 372 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 114 - protein, 124 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 115 - DNA, 333 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 116 - protein, 111 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 117 - DNA, 47 bp, Artificial Sequence
  Description of Artificial Sequence: Synthetic primer
ctgaaatccggaggtggtggatccgagctcgtgatgacccagactcc

SEQ ID NO: 118 - DNA, 52 bp, Artificial Sequence
  Description of Artificial Sequence: Synthetic primer
ggagccgccgccgccagaaccaccaccacctttgatctcaagcttggtcccc

SEQ ID NO: 119 - protein, 10 aa, Artificial Sequence
  Description of Artificial Sequence: Synthetic construct
HYDDHYCLDY

SEQ ID NO: 120 - protein, 10 aa, Artificial Sequence
  Description of Artificial Sequence: Synthetic construct
YSDDHYCLDY

SEQ ID NO: 121 - protein, 10 aa, Artificial Sequence
  Description of Artificial Sequence: Synthetic construct
YYDAHYCLDY

SEQ ID NO: 122 - protein, 10 aa, Artificial Sequence
  Description of Artificial Sequence: Synthetic construct
YYDDQYCLDY

SEQ ID NO: 123 - protein, 10 aa, Artificial Sequence
  Description of Artificial Sequence: Synthetic construct
YYDDPYCLDY

SEQ ID NO: 124 - protein, 10 aa, Artificial Sequence
  Description of Artificial Sequence: Synthetic construct
YFNDHYCLDY

SEQ ID NO: 125 - protein, 10 aa, Artificial Sequence
  Description of Artificial Sequence: Synthetic construct
YYNDQYCLDY

SEQ ID NO: 126 - protein, 10 aa, Artificial Sequence
  Description of Artificial Sequence: Synthetic construct
YHDDPYCLDY

SEQ ID NO: 127 - protein, 10 aa, Artificial Sequence
  Description of Artificial Sequence: Synthetic construct
YYDDNYCLDY

SEQ ID NO: 128 - DNA, 354 bp, Artificial Sequence
  Description of Artificial Sequence: Synthetic construct
cagctggagcagtctggacctgaactgaagaagcctggagagacagtcacgatctcctgcaaggcttctgggtataccttcacgaagttcggaatgaactgggtgaagcaggctccaggaaagggtttaaagtggatgggctggatacacacctccactggagagccaacatattctgatgacttcaagggacggtttgccttctctttggaaacgtctgccagcactgcctatttgcggatcaacaacctcaaaaatgaggacatggctaaatacttctgtgccagaggtggtccttacgtaaggggtgctttggactactggggtcaaggaacctcagtcaccgtctcctcc

SEQ ID NO: 129 - protein, 118 aa, Artificial Sequence
  Description of Artificial Sequence: Synthetic construct
QLEQSGPELKKPGETVTISCKASGYTFTKFGMNWVKQAPGKGLKWMGWIHTSTGEPTYSDDFKGRFAFSLETSASTAYLRINNLKNEDMAKYFCARGGPYVRGALDYWGQGTSVTVSS

SEQ ID NO: 130 - DNA, 333 bp, Artificial Sequence
  Description of Artificial Sequence: Synthetic construct
gacattatcctgatccaatctccaccttctttggctgtgtctctagggcagagggccaccatctcctgcagaaccagcgaaaatgttgacggatacggcattagttttataaactggtaccaacagaagccaggacagccacccaaactcctcatctatgctgcatcccaccaaggatccggggtccctgccagatttagtggcagtgggtctgggacagacttcagcctcaacatccatcctttggaggaggatgatactgcaatgtatttctgtcaccaaagtaagaaggttccgtggacgttcggtggaggcaccaagctggaaatcaaa

SEQ ID NO: 131 - protein, 111 aa, Artificial Sequence
  Description of Artificial Sequence: Synthetic construct
DIILIQSPPSLAVSLGQRATISCRTSENVDGYGISFINWYQQKPGQPPKLLIYAASHQGSGVPARFSGSGSGTDFSLNIHPLEEDDTAMYFCHQSKKVPWTFGGGTKLEIK

SEQ ID NO: 132 - DNA, 360 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctca

SEQ ID NO: 133 - protein, 120 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 134 - DNA, 339 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaa

SEQ ID NO: 135 - protein, 113 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK

SEQ ID NO: 136 - DNA, 360 bp, Artificial Sequence
  Description of Artificial Sequence: Synthetic construct
gaggtgcagctgctcgagcagtctggagctgagctggtgaaacctggggcctcagtgaagatatcctgcaaggcttctggatacgccttcactaactactggctaggttgggtaaagcagaggcctggacatggacttgagtggattggagatcttttccctggaagtggtaatactcactacaatgagaggttcaggggcaaagccacactgactgcagacaaatcctcgagcacagcctttatgcagctcagtagcctgacatctgaggactctgctgtctatttctgtgcaagattgaggaactgggacgaggctatggactactggggccaagggaccacggtcaccgtctcctca

SEQ ID NO: 137 - protein, 120 aa, Artificial Sequence
  Description of Artificial Sequence: Synthetic construct
EVQLLEQSGAELVKPGASVKISCKASGYAFTNYWLGWVKQRPGHGLEWIGDLFPGSGNTHYNERFRGKATLTADKSSSTAFMQLSSLTSEDSAVYFCARLRNWDEAMDYWGQGTTVTVSS

SEQ ID NO: 138 - DNA, 321 bp, Artificial Sequence
  Description of Artificial Sequence: Synthetic construct
gagctcgtcatgacccagtctccatcttatcttgctgcatctcctggagaaaccattactattaattgcagggcaagtaagagcattagcaaatatttagcctggtatcaagagaaacctgggaaaactaataagcttcttatctactctggatccactttgcaatctggaattccatcaaggttcagtggcagtggatctggtacagatttcactctcaccatcagtagcctggagcctgaagattttgcaatgtattactgtcaacagcataatgaatatccgtacacgttcggaggggggaccaagcttgagatcaaa

SEQ ID NO: 139 - protein, 107 aa, Artificial Sequence
  Description of Artificial Sequence: Synthetic construct
ELVMTQSPSYLAASPGETITINCRASKSISKYLAWYQEKPGKTNKLLIYSGSTLQSGIPSRFSGSGSGTDFTLTISSLEPEDFAMYYCQQHNEYPYTFGGGTKLEIK

SEQ ID NO: 140 - DNA, 372 bp, Artificial Sequence
  Description of Artificial Sequence: Synthetic construct
gaggtgcagctgctcgagcagtctggagctgagctggtaaggcctgggacttcagtgaagctgtcctgcaaggcttctggctacaccttcacaagctatggtttaagctgggtgaagcagagaactggacagggccttgagtggattggagaggtttatcctagaattggtaatgcttactacaatgagaagttcaagggcaaggccacactgactgcagacaaatcctccagcacagcgtccatggagctccgcagcctgacatctgaggactctgcggtctatttctgtgcaagacggggatcctacggtagtaactacgactggtacttcgatgtctggggccaagggaccacggtcaccgtctcctca

SEQ ID NO: 141 - protein, 124 aa, Artificial Sequence
  Description of Artificial Sequence: Synthetic construct
EVQLLEQSGAELVRPGTSVKLSCKASGYTFTSYGLSWVKQRTGQGLEWIGEVYPRIGNAYYNEKFKGKATLTADKSSSTASMELRSLTSEDSAVYFCARRGSYGSNYDWYFDVWGQGTTVTVSS

SEQ ID NO: 142 - DNA, 336 bp, Artificial Sequence
  Description of Artificial Sequence: Synthetic construct
gagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 143 - protein, 112 aa, Artificial Sequence
  Description of Artificial Sequence: Synthetic construct
ELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 144 - DNA, 360 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggttaagcagaggcctggacatggacttgaatgggttggagatattttccctggaagtggtaatgctcactacaatgagaagttcaagggcaaagccacactgactgcagacaagtcctcgtacacagcctatatgcagctcagtagcctgacatctgaggactctgctgtctatttctgtgcaagattgcggaactgggacgaggctatggactactggggccaagggaccacggtcaccgtctcctca

SEQ ID NO: 145 - protein, 120 aa, Artificial Sequence
  Description of Artificial Sequence: Synthetic construct
EVQLLEQSGAELVRPGTSVKISCKASGYAFTNYWLGWVKQRPGHGLEWVGDIFPGSGNAHYNEKFKGKATLTADKSSYTAYMQLSSLTSEDSAVYFCARLRNWDEAMDYWGQGTTVTVSS

SEQ ID NO: 146 - DNA, 339 bp, Artificial Sequence
  Description of Artificial Sequence: Synthetic construct
gagctcgtgatgacacagtctccatcctccctgagtgtgtcagcaggagagaaggtcactatgagctgcaagtccagtcagagtctgttaaacagtggaaatcaaaagaactacttggcctggtaccagcagaaaccagggcagcctcctaaactgttgatctacggggcatccactagggaatctggggtccctgatcgcttcacaggcagtggatctggaacagatttcactctcaccatcagcagtgtgcaggctgaagacctggcagtttattactgtcagaatgattatagttatccgtacacgttcggaggggggaccaagcttgagatcaaa

SEQ ID NO: 147 - protein, 113 aa, Artificial Sequence
  Description of Artificial Sequence: Synthetic construct
ELVMTQSPSSLSVSAGEKVTMSCKSSQSLLNSGNQKNYLAWYQQKPGQPPKLLIYGASTRESGVPDRFTGSGSGTDFTLTISSVQAEDLAVYYCQNDYSYPYTFGGGTKLEIK

SEQ ID NO: 148 - DNA, 372 bp, Artificial Sequence
  Description of Artificial Sequence: Synthetic construct
gaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 149 - protein, 124 aa, Artificial Sequence
  Description of Artificial Sequence: Synthetic construct
EVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 150 - DNA, 336 bp, Artificial Sequence; identical to SEQ ID NO: 142
  Description of Artificial Sequence: Synthetic construct

SEQ ID NO: 151 - protein, 112 aa, Artificial Sequence; identical to SEQ ID NO: 143
  Description of Artificial Sequence: Synthetic construct

SEQ ID NO: 152 - protein, 25 aa, Artificial Sequence
  Description of Artificial Sequence: Synthetic construct
DVQLVQSGAEVKKPGASVKVSCKAS

SEQ ID NO: 153 - protein, 25 aa, Artificial Sequence
  Description of Artificial Sequence: Synthetic construct
DVQLVQSGAEVKKPGASVKVSCKAS

SEQ ID NO: 154 - protein, 25 aa, Artificial Sequence
  Description of Artificial Sequence: Synthetic construct
DVQLVQSGAEVKKPGASVKVSCKAS

SEQ ID NO: 155 - protein, 25 aa, Artificial Sequence
  Description of Artificial Sequence: Synthetic construct
DVQLVQSGAEVKKPGASVKVSCKAS

SEQ ID NO: 156 - protein, 15 aa, Artificial Sequence
  Description of Artificial Sequence: Synthetic construct
WVRQAPGQGLEWIGY

SEQ ID NO: 157 - protein, 15 aa, Artificial Sequence
  Description of Artificial Sequence: Synthetic construct
WVRQAPGQGLEWIGY

SEQ ID NO: 158 - protein, 22 aa, Artificial Sequence
  Description of Artificial Sequence: Synthetic construct
WVRQAPGQGLEWIGYINPSRGY

SEQ ID NO: 159 - protein, 22 aa, Artificial Sequence
  Description of Artificial Sequence: Synthetic construct
WVRQAPGQGLEWIGYINPSRGY

SEQ ID NO: 160 - protein, 32 aa, Artificial Sequence
  Description of Artificial Sequence: Synthetic construct
RFTITTDKSTSTAYMELSSLRSEDTATYYCAR

SEQ ID NO: 161 - protein, 32 aa, Artificial Sequence
  Description of Artificial Sequence: Synthetic construct
RVTITTDKSTSTAYMELSSLRSEDTAVYYCAR

SEQ ID NO: 162 - protein, 32 aa, Artificial Sequence
  Description of Artificial Sequence: Synthetic construct
RVTMTTDTSTSTAYMELSSLRSEDTATYYCAR

SEQ ID NO: 163 - protein, 32 aa, Artificial Sequence
  Description of Artificial Sequence: Synthetic construct
RVTMTTDTSTSTAYLQMNSLKTEDTAVYYCAR

SEQ ID NO: 164 - protein, 11 aa, Artificial Sequence
  Description of Artificial Sequence: Synthetic construct
WGQGTTVTVSS

SEQ ID NO: 165 - protein, 11 aa, Artificial Sequence
  Description of Artificial Sequence: Synthetic construct
WGQGTTVTVSS

SEQ ID NO: 166 - protein, 11 aa, Artificial Sequence
  Description of Artificial Sequence: Synthetic construct
WGQGTTVTVSS

SEQ ID NO: 167 - protein, 11 aa, Artificial Sequence
  Description of Artificial Sequence: Synthetic construct
WGQGTTVTVSS

SEQ ID NO: 168 - protein, 15 aa, Artificial Sequence
  Description of Artificial Sequence: Synthetic peptide
GGGGSGGGGSGGGGS

SEQ ID NO: 169 - DNA, 366 bp, Artificial Sequence
  Description of Artificial Sequence: Synthetic construct
caggtgcaactgcggcagcctggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagtctgacatctgaggactctgcggtctattactgtgcaagatcgcactacggtagtaactacgtagactactttgactactggggccaaggcacactagtcacagtctcgaca

SEQ ID NO: 170 - protein, 122 aa, Artificial Sequence
  Description of Artificial Sequence: Synthetic construct
QVQLRQPGAELVKPGASVKMSCKASGYTFTSYNMHWVKQTPGQGLEWIGAIYPGNGDTSYNQKFKGKATLTADKSSSTAYMQLSSLTSEDSAVYYCARSHYGSNYVDYFDYWGQGTLVTVST

SEQ ID NO: 171 - DNA, 318 bp, Artificial Sequence
  Description of Artificial Sequence: Synthetic construct
caaattgttctctcccagtctccagcaatcctttctgcatctccaggggagaaggtcacaatgacttgcagggccagctcaagtttaagtttcatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttatttctgccatcagtggagtagtaacccgctcacgttcggtgctgggacaaaggtggaaataaaa

SEQ ID NO: 172 - protein, 106 aa, Artificial Sequence
  Description of Artificial Sequence: Synthetic construct
QIVLSQSPAILSASPGEKVTMTCRASSSLSFMHWYQQKPGSSPKPWIYATSNLASGVPARFSGSGSGTSYSLTISRVEAEDAATYFCHQWSSNPLTFGAGTKVEIK

SEQ ID NO: 173 - DNA, 15 bp, Artificial Sequence
  Description of Artificial Sequence: Synthetic oligonucleotide
ggaggtggtggatcc

SEQ ID NO: 174 - protein, 5 aa, Artificial Sequence
  Description of Artificial Sequence: Synthetic peptide
GGGGS

SEQ ID NO: 175 - DNA, 18 bp, Artificial Sequence
  Description of Artificial Sequence: Synthetic oligonucleotide
tccggaggtggtggatcc

SEQ ID NO: 176 - protein, 6 aa, Artificial Sequence
  Description of Artificial Sequence: Synthetic peptide
SGGGGS

SEQ ID NO: 177 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 178 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTATRYTMHWVRQAPGQGLEWIGYINPSRGYTNYAQKLQGRVTMTTDTSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 179 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 180 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTATRYTMHWVRQAPGQGLEWIGYINPSRGYTNYAQKLQGRVTMTTDTSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 181 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 182 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTATRYTMHWVRQAPGQGLEWIGYINPSRGYTNYAQKLQGRVTMTTDTSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 183 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacctgcaaatgaacagcctgaaaactgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 184 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTATRYTMHWVRQAPGQGLEWIGYINPSRGYTNYAQKLQGRVTMTTDTSTSTAYLQMNSLKTEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 185 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacctgcaaatgaacagcctgaaaactgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 186 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTATRYTMHWVRQAPGQGLEWIGYINPSRGYTNYAQKLQGRVTMTTDTSTSTAYLQMNSLKTEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 187 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacaccgctactaggtacacgatgcactgggtaaggcaggcacctggacagggtctggaatggattggatacattaatcctagccgtggttatactaattacgcacagaagttgcagggccgcgtcacaatgactacagacacttccaccagcacagcctacctgcaaatgaacagcctgaaaactgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 188 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTATRYTMHWVRQAPGQGLEWIGYINPSRGYTNYAQKLQGRVTMTTDTSTSTAYLQMNSLKTEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 189 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 190 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 191 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 192 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 193 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 194 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 195 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 196 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 197 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 198 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 199 - DNA, 1527 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggctccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaacatcatcaccatcatcattagagatctgtcgac

SEQ ID NO: 200 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 201 - DNA, 45 bp, Artificial Sequence
  Description of Artificial Sequence: Synthetic oligonucleotide
ggtggtggtggttctggcggcggcggctccggtggtggtggttct

SEQ ID NO: 202 - DNA, 54 bp, Artificial Sequence
  Description of Artificial Sequence: Synthetic oligonucleotide
ggcgaaggtactagtactggttctggtggaagtggaggttcaggtggagcagac

SEQ ID NO: 203 - DNA, 1494 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggatccgatatcaaactgcagcagtcaggggctgaactggcaagacctggggcctcagtgaagatgtcctgcaagacttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcagtcgaaggtggaagtggaggttctggtggaagtggaggttcaggtggagtcgacgacattcagctgacccagtctccagcaatcatgtctgcatctccaggggagaaggtcaccatgacctgcagagccagttcaagtgtaagttacatgaactggtaccagcagaagtcaggcacctcccccaaaagatggatttatgacacatccaaagtggcttctggagtcccttatcgcttcagtggcagtgggtctgggacctcatactctctcacaatcagcagcatggaggctgaagatgctgccacttattactgccaacagtggagtagtaacccgctcacgttcggtgctgggaccaagctggagctgaaa

SEQ ID NO: 204 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 205 - DNA, 1476 bp, Artificial Sequence
  Description of Artificial Sequence: Synthetic construct
gacattatcctgatccaatctccaccttctttggctgtgtctctagggcagagggccaccatctcctgcagaaccagcgaaaatgttgacggatacggcattagttttataaactggtaccaacagaagccaggacagccacccaaactcctcatctatgctgcatcccaccaaggatccggggtccctgccagatttagtggcagtgggtctgggacagacttcagcctcaacatccatcctttggaggaggatgatactgcaatgtatttctgtcaccaaagtaagaaggttccgtggacgttcggtggaggcaccaagctggaaatcaaaggtggtggtggttctggcggcggcggctccggtggtggtggttctcagctggagcagtctggacctgaactgaagaagcctggagagacagtcacgatctcctgcaaggcttctgggtataccttcacgaagttcggaatgaactgggtgaagcaggctccaggaaagggtttaaagtggatgggctggatacacacctccactggagagccaacatattctgatgacttcaagggacggtttgccttctctttggaaacgtctgccagcactgcctatttgcggatcaacaacctcaaaaatgaggacatggctaaatacttctgtgccagaggtggtccttacgtaaggggtgctttggactactggggtcaaggaacctcagtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 206 - protein, 492 aa, Artificial Sequence
  Description of Artificial Sequence: Synthetic construct
DIILIQSPPSLAVSLGQRATISCRTSENVDGYGISFINWYQQKPGQPPKLLIYAASHQGSGVPARFSGSGSGTDFSLNIHPLEEDDTAMYFCHQSKKVPWTFGGGTKLEIKGGGGSGGGGSGGGGSQLEQSGPELKKPGETVTISCKASGYTFTKFGMNWVKQAPGKGLKWMGWIHTSTGEPTYSDDFKGRFAFSLETSASTAYLRINNLKNEDMAKYFCARGGPYVRGALDYWGQGTSVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 207 - DNA, 1476 bp, Artificial Sequence
  Description of Artificial Sequence: Synthetic construct
gacattatcctgatccaatctccaccttctttggctgtgtctctagggcagagggccaccatctcctgcagaaccagcgaaaatgttgacggatacggcattagttttataaactggtaccaacagaagccaggacagccacccaaactcctcatctatgctgcatcccaccaaggatccggggtccctgccagatttagtggcagtgggtctgggacagacttcagcctcaacatccatcctttggaggaggatgatactgcaatgtatttctgtcaccaaagtaagaaggttccgtggacgttcggtggaggcaccaagctggaaatcaaaggtggtggtggttctggcggcggcggctccggtggtggtggttctcagctggagcagtctggacctgaactgaagaagcctggagagacagtcacgatctcctgcaaggcttctgggtataccttcacgaagttcggaatgaactgggtgaagcaggctccaggaaagggtttaaagtggatgggctggatacacacctccactggagagccaacatattctgatgacttcaagggacggtttgccttctctttggaaacgtctgccagcactgcctatttgcggatcaacaacctcaaaaatgaggacatggctaaatacttctgtgccagaggtggtccttacgtaaggggtgctttggactactggggtcaaggaacctcagtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 208 - protein, 492 aa, Artificial Sequence
  Description of Artificial Sequence: Synthetic construct
DIILIQSPPSLAVSLGQRATISCRTSENVDGYGISFINWYQQKPGQPPKLLIYAASHQGSGVPARFSGSGSGTDFSLNIHPLEEDDTAMYFCHQSKKVPWTFGGGTKLEIKGGGGSGGGGSGGGGSQLEQSGPELKKPGETVTISCKASGYTFTKFGMNWVKQAPGKGLKWMGWIHTSTGEPTYSDDFKGRFAFSLETSASTAYLRINNLKNEDMAKYFCARGGPYVRGALDYWGQGTSVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 209 - DNA, 1476 bp, Artificial Sequence
  Description of Artificial Sequence: Synthetic construct
gacattatcctgatccaatctccaccttctttggctgtgtctctagggcagagggccaccatctcctgcagaaccagcgaaaatgttgacggatacggcattagttttataaactggtaccaacagaagccaggacagccacccaaactcctcatctatgctgcatcccaccaaggatccggggtccctgccagatttagtggcagtgggtctgggacagacttcagcctcaacatccatcctttggaggaggatgatactgcaatgtatttctgtcaccaaagtaagaaggttccgtggacgttcggtggaggcaccaagctggaaatcaaaggtggtggtggttctggcggcggcggctccggtggtggtggttctcagctggagcagtctggacctgaactgaagaagcctggagagacagtcacgatctcctgcaaggcttctgggtataccttcacgaagttcggaatgaactgggtgaagcaggctccaggaaagggtttaaagtggatgggctggatacacacctccactggagagccaacatattctgatgacttcaagggacggtttgccttctctttggaaacgtctgccagcactgcctatttgcggatcaacaacctcaaaaatgaggacatggctaaatacttctgtgccagaggtggtccttacgtaaggggtgctttggactactggggtcaaggaacctcagtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 210 - protein, 492 aa, Artificial Sequence
  Description of Artificial Sequence: Synthetic construct
DIILIQSPPSLAVSLGQRATISCRTSENVDGYGISFINWYQQKPGQPPKLLIYAASHQGSGVPARFSGSGSGTDFSLNIHPLEEDDTAMYFCHQSKKVPWTFGGGTKLEIKGGGGSGGGGSGGGGSQLEQSGPELKKPGETVTISCKASGYTFTKFGMNWVKQAPGKGLKWMGWIHTSTGEPTYSDDFKGRFAFSLETSASTAYLRINNLKNEDMAKYFCARGGPYVRGALDYWGQGTSVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 211 - DNA, 1476 bp, Artificial Sequence
  Description of Artificial Sequence: Synthetic construct
gacattatcctgatccaatctccaccttctttggctgtgtctctagggcagagggccaccatctcctgcagaaccagcgaaaatgttgacggatacggcattagttttataaactggtaccaacagaagccaggacagccacccaaactcctcatctatgctgcatcccaccaaggatccggggtccctgccagatttagtggcagtgggtctgggacagacttcagcctcaacatccatcctttggaggaggatgatactgcaatgtatttctgtcaccaaagtaagaaggttccgtggacgttcggtggaggcaccaagctggaaatcaaaggtggtggtggttctggcggcggcggctccggtggtggtggttctcagctggagcagtctggacctgaactgaagaagcctggagagacagtcacgatctcctgcaaggcttctgggtataccttcacgaagttcggaatgaactgggtgaagcaggctccaggaaagggtttaaagtggatgggctggatacacacctccactggagagccaacatattctgatgacttcaagggacggtttgccttctctttggaaacgtctgccagcactgcctatttgcggatcaacaacctcaaaaatgaggacatggctaaatacttctgtgccagaggtggtccttacgtaaggggtgctttggactactggggtcaaggaacctcagtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 212 - protein, 492 aa, Artificial Sequence
  Description of Artificial Sequence: Synthetic construct
DIILIQSPPSLAVSLGQRATISCRTSENVDGYGISFINWYQQKPGQPPKLLIYAASHQGSGVPARFSGSGSGTDFSLNIHPLEEDDTAMYFCHQSKKVPWTFGGGTKLEIKGGGGSGGGGSGGGGSQLEQSGPELKKPGETVTISCKASGYTFTKFGMNWVKQAPGKGLKWMGWIHTSTGEPTYSDDFKGRFAFSLETSASTAYLRINNLKNEDMAKYFCARGGPYVRGALDYWGQGTSVTVSSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 213 - DNA, 1476 bp, Artificial Sequence
  Description of Artificial Sequence: Synthetic construct
gacattatcctgatccaatctccaccttctttggctgtgtctctagggcagagggccaccatctcctgcagaaccagcgaaaatgttgacggatacggcattagttttataaactggtaccaacagaagccaggacagccacccaaactcctcatctatgctgcatcccaccaaggatccggggtccctgccagatttagtggcagtgggtctgggacagacttcagcctcaacatccatcctttggaggaggatgatactgcaatgtatttctgtcaccaaagtaagaaggttccgtggacgttcggtggaggcaccaagctggaaatcaaaggtggtggtggttctggcggcggcggctccggtggtggtggttctcagctggagcagtctggacctgaactgaagaagcctggagagacagtcacgatctcctgcaaggcttctgggtataccttcacgaagttcggaatgaactgggtgaagcaggctccaggaaagggtttaaagtggatgggctggatacacacctccactggagagccaacatattctgatgacttcaagggacggtttgccttctctttggaaacgtctgccagcactgcctatttgcggatcaacaacctcaaaaatgaggacatggctaaatacttctgtgccagaggtggtccttacgtaaggggtgctttggactactggggtcaaggaacctcagtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 214 - protein, 492 aa, Artificial Sequence
  Description of Artificial Sequence: Synthetic construct
DIILIQSPPSLAVSLGQRATISCRTSENVDGYGISFINWYQQKPGQPPKLLIYAASHQGSGVPARFSGSGSGTDFSLNIHPLEEDDTAMYFCHQSKKVPWTFGGGTKLEIKGGGGSGGGGSGGGGSQLEQSGPELKKPGETVTISCKASGYTFTKFGMNWVKQAPGKGLKWMGWIHTSTGEPTYSDDFKGRFAFSLETSASTAYLRINNLKNEDMAKYFCARGGPYVRGALDYWGQGTSVTVSSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 215 - DNA, 1476 bp, Artificial Sequence
  Description of Artificial Sequence: Synthetic construct
gacattatcctgatccaatctccaccttctttggctgtgtctctagggcagagggccaccatctcctgcagaaccagcgaaaatgttgacggatacggcattagttttataaactggtaccaacagaagccaggacagccacccaaactcctcatctatgctgcatcccaccaaggatccggggtccctgccagatttagtggcagtgggtctgggacagacttcagcctcaacatccatcctttggaggaggatgatactgcaatgtatttctgtcaccaaagtaagaaggttccgtggacgttcggtggaggcaccaagctggaaatcaaaggtggtggtggttctggcggcggcggctccggtggtggtggttctcagctggagcagtctggacctgaactgaagaagcctggagagacagtcacgatctcctgcaaggcttctgggtataccttcacgaagttcggaatgaactgggtgaagcaggctccaggaaagggtttaaagtggatgggctggatacacacctccactggagagccaacatattctgatgacttcaagggacggtttgccttctctttggaaacgtctgccagcactgcctatttgcggatcaacaacctcaaaaatgaggacatggctaaatacttctgtgccagaggtggtccttacgtaaggggtgctttggactactggggtcaaggaacctcagtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 216 - protein, 492 aa, Artificial Sequence
  Description of Artificial Sequence: Synthetic construct
DIILIQSPPSLAVSLGQRATISCRTSENVDGYGISFINWYQQKPGQPPKLLIYAASHQGSGVPARFSGSGSGTDFSLNIHPLEEDDTAMYFCHQSKKVPWTFGGGTKLEIKGGGGSGGGGSGGGGSQLEQSGPELKKPGETVTISCKASGYTFTKFGMNWVKQAPGKGLKWMGWIHTSTGEPTYSDDFKGRFAFSLETSASTAYLRINNLKNEDMAKYFCARGGPYVRGALDYWGQGTSVTVSSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 217 - DNA, 1473 bp, Artificial Sequence
  Description of Artificial Sequence: Synthetic construct
caaattgttctctcccagtctccagcaatcctttctgcatctccaggggagaaggtcacaatgacttgcagggccagctcaagtttaagtttcatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttatttctgccatcagtggagtagtaacccgctcacgttcggtgctgggacaaaggtggaaataaaaggtggtggtggttctggcggcggcggctccggtggtggtggttctcaggtgcaactgcggcagcctggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagtctgacatctgaggactctgcggtctattactgtgcaagatcgcactacggtagtaactacgtagactactttgactactggggccaaggcacactagtcacagtctcgacaggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 218 - protein, 491 aa, Artificial Sequence
  Description of Artificial Sequence: Synthetic construct
QIVLSQSPAILSASPGEKVTMTCRASSSLSFMHWYQQKPGSSPKPWIYATSNLASGVPARFSGSGSGTSYSLTISRVEAEDAATYFCHQWSSNPLTFGAGTKVEIKGGGGSGGGGSGGGGSQVQLRQPGAELVKPGASVKMSCKASGYTFTSYNMHWVKQTPGQGLEWIGAIYPGNGDTSYNQKFKGKATLTADKSSSTAYMQLSSLTSEDSAVYYCARSHYGSNYVDYFDYWGQGTLVTVSTGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 219 - DNA, 1473 bp, Artificial Sequence
  Description of Artificial Sequence: Synthetic construct
caaattgttctctcccagtctccagcaatcctttctgcatctccaggggagaaggtcacaatgacttgcagggccagctcaagtttaagtttcatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttatttctgccatcagtggagtagtaacccgctcacgttcggtgctgggacaaaggtggaaataaaaggtggtggtggttctggcggcggcggctccggtggtggtggttctcaggtgcaactgcggcagcctggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagtctgacatctgaggactctgcggtctattactgtgcaagatcgcactacggtagtaactacgtagactactttgactactggggccaaggcacactagtcacagtctcgacaggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 220 - protein, 491 aa, Artificial Sequence
  Description of Artificial Sequence: Synthetic construct
QIVLSQSPAILSASPGEKVTMTCRASSSLSFMHWYQQKPGSSPKPWIYATSNLASGVPARFSGSGSGTSYSLTISRVEAEDAATYFCHQWSSNPLTFGAGTKVEIKGGGGSGGGGSGGGGSQVQLRQPGAELVKPGASVKMSCKASGYTFTSYNMHWVKQTPGQGLEWIGAIYPGNGDTSYNQKFKGKATLTADKSSSTAYMQLSSLTSEDSAVYYCARSHYGSNYVDYFDYWGQGTLVTVSTGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 221 - DNA, 1473 bp, Artificial Sequence
  Description of Artificial Sequence: Synthetic construct
caaattgttctctcccagtctccagcaatcctttctgcatctccaggggagaaggtcacaatgacttgcagggccagctcaagtttaagtttcatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttatttctgccatcagtggagtagtaacccgctcacgttcggtgctgggacaaaggtggaaataaaaggtggtggtggttctggcggcggcggctccggtggtggtggttctcaggtgcaactgcggcagcctggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagtctgacatctgaggactctgcggtctattactgtgcaagatcgcactacggtagtaactacgtagactactttgactactggggccaaggcacactagtcacagtctcgacaggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 222 - protein, 491 aa, Artificial Sequence
  Description of Artificial Sequence: Synthetic construct
QIVLSQSPAILSASPGEKVTMTCRASSSLSFMHWYQQKPGSSPKPWIYATSNLASGVPARFSGSGSGTSYSLTISRVEAEDAATYFCHQWSSNPLTFGAGTKVEIKGGGGSGGGGSGGGGSQVQLRQPGAELVKPGASVKMSCKASGYTFTSYNMHWVKQTPGQGLEWIGAIYPGNGDTSYNQKFKGKATLTADKSSSTAYMQLSSLTSEDSAVYYCARSHYGSNYVDYFDYWGQGTLVTVSTGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 223 - DNA, 1473 bp, Artificial Sequence
  Description of Artificial Sequence: Synthetic construct
caaattgttctctcccagtctccagcaatcctttctgcatctccaggggagaaggtcacaatgacttgcagggccagctcaagtttaagtttcatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttatttctgccatcagtggagtagtaacccgctcacgttcggtgctgggacaaaggtggaaataaaaggtggtggtggttctggcggcggcggctccggtggtggtggttctcaggtgcaactgcggcagcctggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagtctgacatctgaggactctgcggtctattactgtgcaagatcgcactacggtagtaactacgtagactactttgactactggggccaaggcacactagtcacagtctcgacaggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 224 - protein, 491 aa, Artificial Sequence
  Description of Artificial Sequence: Synthetic construct
QIVLSQSPAILSASPGEKVTMTCRASSSLSFMHWYQQKPGSSPKPWIYATSNLASGVPARFSGSGSGTSYSLTISRVEAEDAATYFCHQWSSNPLTFGAGTKVEIKGGGGSGGGGSGGGGSQVQLRQPGAELVKPGASVKMSCKASGYTFTSYNMHWVKQTPGQGLEWIGAIYPGNGDTSYNQKFKGKATLTADKSSSTAYMQLSSLTSEDSAVYYCARSHYGSNYVDYFDYWGQGTLVTVSTGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 225 - DNA, 1473 bp, Artificial Sequence
  Description of Artificial Sequence: Synthetic construct
caaattgttctctcccagtctccagcaatcctttctgcatctccaggggagaaggtcacaatgacttgcagggccagctcaagtttaagtttcatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttatttctgccatcagtggagtagtaacccgctcacgttcggtgctgggacaaaggtggaaataaaaggtggtggtggttctggcggcggcggctccggtggtggtggttctcaggtgcaactgcggcagcctggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagtctgacatctgaggactctgcggtctattactgtgcaagatcgcactacggtagtaactacgtagactactttgactactggggccaaggcacactagtcacagtctcgacaggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 226 - protein, 491 aa, Artificial Sequence
  Description of Artificial Sequence: Synthetic construct
QIVLSQSPAILSASPGEKVTMTCRASSSLSFMHWYQQKPGSSPKPWIYATSNLASGVPARFSGSGSGTSYSLTISRVEAEDAATYFCHQWSSNPLTFGAGTKVEIKGGGGSGGGGSGGGGSQVQLRQPGAELVKPGASVKMSCKASGYTFTSYNMHWVKQTPGQGLEWIGAIYPGNGDTSYNQKFKGKATLTADKSSSTAYMQLSSLTSEDSAVYYCARSHYGSNYVDYFDYWGQGTLVTVSTGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 227 - DNA, 1473 bp, Artificial Sequence
  Description of Artificial Sequence: Synthetic construct
caaattgttctctcccagtctccagcaatcctttctgcatctccaggggagaaggtcacaatgacttgcagggccagctcaagtttaagtttcatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttatttctgccatcagtggagtagtaacccgctcacgttcggtgctgggacaaaggtggaaataaaaggtggtggtggttctggcggcggcggctccggtggtggtggttctcaggtgcaactgcggcagcctggggctgagctggtgaagcctggggcctcagtgaagatgtcctgcaaggcttctggctacacatttaccagttacaatatgcactgggtaaagcagacacctggacagggcctggaatggattggagctatttatccaggaaatggtgatacttcctacaatcagaagttcaaaggcaaggccacattgactgcagacaaatcctccagcacagcctacatgcagctcagcagtctgacatctgaggactctgcggtctattactgtgcaagatcgcactacggtagtaactacgtagactactttgactactggggccaaggcacactagtcacagtctcgacaggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 228 - protein, 491 aa, Artificial Sequence
  Description of Artificial Sequence: Synthetic construct
QIVLSQSPAILSASPGEKVTMTCRASSSLSFMHWYQQKPGSSPKPWIYATSNLASGVPARFSGSGSGTSYSLTISRVEAEDAATYFCHQWSSNPLTFGAGTKVEIKGGGGSGGGGSGGGGSQVQLRQPGAELVKPGASVKMSCKASGYTFTSYNMHWVKQTPGQGLEWIGAIYPGNGDTSYNQKFKGKATLTADKSSSTAYMQLSSLTSEDSAVYYCARSHYGSNYVDYFDYWGQGTLVTVSTGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 229 - protein, 25 aa, Artificial Sequence
  Description of Artificial Sequence: Synthetic construct
DIKLQQSGAELARPGASVKMSCKTS

SEQ ID NO: 230 - protein, 15 aa, Artificial Sequence
  Description of Artificial Sequence: Synthetic construct
WVKQRPGQGLEWIGY

SEQ ID NO: 231 - protein, 32 aa, Artificial Sequence
  Description of Artificial Sequence: Synthetic construct
KATLTTDKSSSTAYMQLSSLTSEDSAVYYCAR

SEQ ID NO: 232 - protein, 11 aa, Artificial Sequence
  Description of Artificial Sequence: Synthetic construct
WGQGTTLTVSS

SEQ ID NO: 233 - protein, 6 aa, Artificial Sequence
  Description of Artificial Sequence: Synthetic peptide
ASGYTF

SEQ ID NO: 234 - protein, 4 aa, Artificial Sequence
  Description of Artificial Sequence: Synthetic peptide
MELS

SEQ ID NO: 235 - protein, 5 aa, Artificial Sequence
  Description of Artificial Sequence: Synthetic peptide
ITTDK

SEQ ID NO: 236 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 237 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 238 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 239 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 240 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 241 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 242 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 243 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 244 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 245 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 246 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 247 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 248 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 249 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 250 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 251 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 252 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 253 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 254 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 255 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 256 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 257 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 258 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 259 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 260 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 261 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 262 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 263 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 264 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 265 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 266 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 267 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 268 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 269 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 270 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 271 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 272 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 273 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 274 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 275 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 276 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 277 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 278 - DNA, 1488 bp, Artificial Sequence
  Description of Artificial Sequence: Synthetic construct
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 279 - protein, 496 aa, Artificial Sequence
  Description of Artificial Sequence: Synthetic construct
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 280 - DNA, 1491 bp, Artificial Sequence
  Description of Artificial Sequence: Synthetic construct
gaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaatccggaggtggtggatccgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 281 - protein, 497 aa, Artificial Sequence
  Description of Artificial Sequence: Synthetic construct
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKSGGGGSDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 282 - DNA, 1497 bp, Artificial Sequence
  Description of Artificial Sequence: Synthetic construct
gacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 283 - protein, 499 aa, Artificial Sequence
  Description of Artificial Sequence: Synthetic construct
DIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 284 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 285 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 286 - DNA, 1497 bp, Artificial Sequence
  Description of Artificial Sequence: Synthetic construct
gacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 287 - protein, 499 aa, Artificial Sequence
  Description of Artificial Sequence: Synthetic construct
DIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 288 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 289 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 290 - DNA, 1497 bp, Artificial Sequence
  Description of Artificial Sequence: Synthetic construct
gacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 291 - protein, 499 aa, Artificial Sequence
  Description of Artificial Sequence: Synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 292 - DNA, 1497 bp, Artificial Sequence
  Description of Artificial Sequence: Synthetic construct
gacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 293 - protein, 499 aa, Artificial Sequence
  Description of Artificial Sequence: Synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 294 - DNA, 1497 bp, Artificial Sequence
  Description of Artificial Sequence: Synthetic construct
gacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 295 - protein, 499 aa, Artificial Sequence
  Description of Artificial Sequence: Synthetic construct
DIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 296 - DNA, 1503 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaacat

SEQ ID NO: 297 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 298 - DNA, 1497 bp, Artificial Sequence
  Description of Artificial Sequence: Synthetic construct
gacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 299 - protein, 499 aa, Artificial Sequence
  Description of Artificial Sequence: Synthetic construct
DIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 300 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 301 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 302 - DNA, 1497 bp, Artificial Sequence
  Description of Artificial Sequence: Synthetic construct
gacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 303 - protein, 499 aa, Artificial Sequence
  Description of Artificial Sequence: Synthetic construct
DIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 304 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 305 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 306 - DNA, 1497 bp, Artificial Sequence
  Description of Artificial Sequence: Synthetic construct
gacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 307 - protein, 499 aa, Artificial Sequence
  Description of Artificial Sequence: Synthetic construct
DIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 308 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 309 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 310 - DNA, 1497 bp, Artificial Sequence
  Description of Artificial Sequence: Synthetic construct
gacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 311 - protein, 499 aa, Artificial Sequence
  Description of Artificial Sequence: Synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 312 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 313 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 314 - DNA, 1497 bp, Artificial Sequence
  Description of Artificial Sequence: Synthetic construct
gacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 315 - protein, 499 aa, Artificial Sequence
  Description of Artificial Sequence: Synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 316 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 317 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 318 - DNA, 1497 bp, Artificial Sequence
  Description of Artificial Sequence: Synthetic construct
gacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 319 - protein, 499 aa, Artificial Sequence
  Description of Artificial Sequence: Synthetic construct
DIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 320 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctcaggtggtggtggttctggcggcggcggctccggtggtggtggttctgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaa

SEQ ID NO: 321 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 322 - DNA, 1497 bp, Artificial Sequence
  Description of Artificial Sequence: Synthetic construct
gacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 323 - protein, 499 aa, Artificial Sequence
  Description of Artificial Sequence: Synthetic construct
DIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 324 - DNA, 1500 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgagctcgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagcttgagatcaaaggtggtggtggttctggcggcggcggctccggtggtggtggttctgaggtgcagctgctcgagcagtctggagctgagctggcgaggcctggggcttcagtgaagctgtcctgcaaggcttctggctacaccttcacaaactatggtttaagctgggtgaagcagaggcctggacaggtccttgagtggattggagaggtttatcctagaattggtaatgcttactacaatgagaagttcaagggcaaggccacactgactgcagacaaatcctccagcacagcgtccatggagctccgcagcctgacctctgaggactctgcggtctatttctgtgcaagacggggatcctacgatactaactacgactggtacttcgatgtctggggccaagggaccacggtcaccgtctcctca

SEQ ID NO: 325 - protein, 500 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKGGGGSGGGGSGGGGSEVQLLEQSGAELARPGASVKLSCKASGYTFTNYGLSWVKQRPGQVLEWIGEVYPRIGNAYYNEKFKGKATLTADKSSSTASMELRSLTSEDSAVYFCARRGSYDTNYDWYFDVWGQGTTVTVSS

SEQ ID NO: 326 - DNA, 1494 bp, Artificial Sequence
  Description of Artificial Sequence: Synthetic construct
gacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 327 - protein, 498 aa, Artificial Sequence
  Description of Artificial Sequence: Synthetic construct
DIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 328 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 329 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 330 - DNA, 1494 bp, Artificial Sequence
  Description of Artificial Sequence: Synthetic construct
gacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 331 - protein, 498 aa, Artificial Sequence
  Description of Artificial Sequence: Synthetic construct
DIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 332 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 333 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 334 - DNA, 1494 bp, Artificial Sequence
  Description of Artificial Sequence: Synthetic construct
gacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 335 - protein, 498 aa, Artificial Sequence
  Description of Artificial Sequence: Synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 336 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 337 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 338 - DNA, 1494 bp, Artificial Sequence
  Description of Artificial Sequence: Synthetic construct
gacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 339 - protein, 498 aa, Artificial Sequence
  Description of Artificial Sequence: Synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 340 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 341 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 342 - DNA, 1494 bp, Artificial Sequence
  Description of Artificial Sequence: Synthetic construct
gacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 343 - protein, 498 aa, Artificial Sequence
  Description of Artificial Sequence: Synthetic construct
DIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 344 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 345 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 346 - DNA, 1494 bp, Artificial Sequence
  Description of Artificial Sequence: Synthetic construct
gacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 347 - protein, 498 aa, Artificial Sequence
  Description of Artificial Sequence: Synthetic construct
DIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 348 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 349 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 350 - DNA, 1494 bp, Artificial Sequence
  Description of Artificial Sequence: Synthetic construct
gacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 351 - protein, 498 aa, Artificial Sequence
  Description of Artificial Sequence: Synthetic construct
DIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 352 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 353 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 354 - DNA, 1494 bp, Artificial Sequence
  Description of Artificial Sequence: Synthetic construct
gacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 355 - protein, 498 aa, Artificial Sequence
  Description of Artificial Sequence: Synthetic construct
DIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 356 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 357 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 358 - DNA, 1494 bp, Artificial Sequence
  Description of Artificial Sequence: Synthetic construct
gacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 359 - protein, 498 aa, Artificial Sequence
  Description of Artificial Sequence: Synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 360 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 361 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 362 - DNA, 1494 bp, Artificial Sequence
  Description of Artificial Sequence: Synthetic construct
gacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 363 - protein, 498 aa, Artificial Sequence
  Description of Artificial Sequence: Synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 364 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 365 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 366 - DNA, 1494 bp, Artificial Sequence
  Description of Artificial Sequence: Synthetic construct
gacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 367 - protein, 498 aa, Artificial Sequence
  Description of Artificial Sequence: Synthetic construct
DIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 368 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatcccaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaa

SEQ ID NO: 369 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 370 - DNA, 1494 bp, Artificial Sequence
  Description of Artificial Sequence: Synthetic construct
gacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 371 - protein, 498 aa, Artificial Sequence
  Description of Artificial Sequence: Synthetic construct
DIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 372 - DNA, 1497 bp, Artificial Sequence
  Description of Artificial Sequence: Synthetic construct
gacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaatccggaggtggtggatccgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctcc

SEQ ID NO: 373 - protein, 499 aa, Artificial Sequence
  Description of Artificial Sequence: Synthetic construct
DVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 374 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 375 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 376 - DNA, 1494 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggatccgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 377 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 378 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 379 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 380 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 381 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 382 - DNA, 1494 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggatccgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 383 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 384 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 385 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 386 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 387 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 388 - DNA, 1494 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggatccgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 389 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 390 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacgcagacagcgtcaagggccgcttcacaatcactacagacaaatccaccagcacagcctacatggaactgagcagcctgcgttctgaggacactgcaacctattactgtgcaagatattatgatgatcattactgccttgactactggggccaaggcaccacggtcaccgtctcctca

SEQ ID NO: 391 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 392 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 393 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 394 - DNA, 1494 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggatccgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 395 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 396 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacattcagatgacccagtctccatctagcctgtctgcatctgtcggggaccgtgtcaccatcacctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 397 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDIQMTQSPSSLSASVGDRVTITCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 398 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 399 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 400 - DNA, 1494 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggatccgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 401 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 402 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacattgtactgacccagtctccagcaactctgtctctgtctccaggggagcgtgccaccctgagctgcagagccagtcaaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 403 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 404 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctcaggcgaaggtactagtactggttctggtggaagtggaggttcaggtggagcagacgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaa

SEQ ID NO: 405 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSSGEGTSTGSGGSGGSGGADDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIK

SEQ ID NO: 406 - DNA, 1494 bp, Artificial Sequence
  Description of Artificial Sequence: Synthetic construct
gatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaaggtggtggtggttctggcggcggcggctccggtggtggtggttctcaggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggaggtggtggatccgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 407 - protein, 498 aa, Artificial Sequence
  Description of Artificial Sequence: Synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 408 - DNA, 1497 bp, Artificial Sequence
  Description of Artificial Sequence: Synthetic construct
caggtgcagctgcagcagtctggggctgagctggtgaggcctgggtcctcagtgaagatttcctgcaaggcttctggctatgcattcagtagctactggatgaactgggtgaagcagaggcctggacagggtcttgagtggattggacagatttggcctggagatggtgatactaactacaatggaaagttcaagggtaaagccactctgactgcagacgaatcctccagcacagcctacatgcaactcagcagcctagcatctgaggactctgcggtctatttctgtgcaagacgggagactacgacggtaggccgttattactatgctatggactactggggccaagggaccacggtcaccgtctcctccggtggtggtggttctggcggcggcggctccggtggtggtggttctgatatccagctgacccagtctccagcttctttggctgtgtctctagggcagagggccaccatctcctgcaaggccagccaaagtgttgattatgatggtgatagttatttgaactggtaccaacagattccaggacagccacccaaactcctcatctatgatgcatccaatctagtttctgggatcccacccaggtttagtggcagtgggtctgggacagacttcaccctcaacatccatcctgtggagaaggtggatgctgcaacctatcactgtcagcaaagtactgaggatccgtggacgttcggtggagggaccaagctcgagatcaaatccggaggtggtggatccgacattgtactgacccagtctccagcaactctgtctctgtctccaggggagcgtgccaccctgacctgcagagccagttcaagtgtaagttacatgaactggtaccagcagaagccgggcaaggcacccaaaagatggatttatgacacatccaaagtggcttctggagtccctgctcgcttcagtggcagtgggtctgggaccgactactctctcacaatcaacagcttggaggctgaagatgctgccacttattactgccaacagtggagtagtaacccgctcacgttcggtggcgggaccaaggtggagatcaaaggcgaaggtactagtactggttctggtggaagtggaggttcaggtggagcagacgacgtccaactggtgcagtcaggggctgaagtgaaaaaacctggggcctcagtgaaggtgtcctgcaaggcttctggctacacctttactaggtacacgatgcactgggtaaggcaggcacctggacagggtctggaatggattggatacattaatcctagccgtggttatactaattacaatcagaagttcaaggaccgcgtcacaatcactacagacaaatccaccagcacagcctacatggaactgagcagcctgcgttctgaggacactgcagtctattactgtgcaagatattatgatgatcattactgccttgactactggggccaaggcaccacggtcaccgtctcctca

SEQ ID NO: 409 - protein, 499 aa, Artificial Sequence
  Description of Artificial Sequence: Synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSGGGGSGGGGSDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKSGGGGSDIVLTQSPATLSLSPGERATLTCRASSSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYNQKFKDRVTITTDKSTSTAYMELSSLRSEDTAVYYCARYYDDHYCLDYWGQGTTVTVSS

SEQ ID NO: 410 - protein, 6 aa, Artificial Sequence
  Description of Artificial Sequence: Synthetic peptide
TSGYTF

SEQ ID NO: 411 - protein, 6 aa, Artificial Sequence
  Description of Artificial Sequence: Synthetic peptide
ASGYTA

SEQ ID NO: 412 - protein, 5 aa, Artificial Sequence
  Description of Artificial Sequence: Synthetic peptide
LTTDK

SEQ ID NO: 413 - protein, 5 aa, Artificial Sequence
  Description of Artificial Sequence: Synthetic peptide
MTTDT

SEQ ID NO: 414 - protein, 4 aa, Artificial Sequence
  Description of Artificial Sequence: Synthetic peptide
MQLS

SEQ ID NO: 415 - protein, 4 aa, Artificial Sequence
  Description of Artificial Sequence: Synthetic peptide
LQMN

The invention claimed is:

1. A cytotoxically active CD3 specific binding construct comprising a first domain specifically binding to human CD3 and an Ig-derived second binding domain
    wherein said first domain is deimmunized and comprises a CDR-H1 region as depicted in SEQ ID NO.:88, a CDR-H2 region as depicted in SEQ ID NO.:90 or SEQ ID NO.:92 and a CDR-H3 region, said CDR-H3 region comprising an amino acid sequence as depicted in SEQ ID NO.: 96, 108, 119, 120, 121, 122, 123, 124, 125, 126, or 127; and
    wherein said first domain further comprises in its framework H1 the sequence VKK and wherein the transition sequence between framework H1 and CDRH1 region comprises the sequence Ala-Ser-Gly-Tyr-Thr-Phe (AS-GYTF; SEQ ID NO.: 233); and
    wherein said construct comprises a CDR-L1 as depicted in SEQ ID NO.: 98 or SEQ ID NO.:100, a CDR-L2 as depicted in SEQ ID NO.: 102, and a CDR-L3 as depicted in SEQ ID NO.:104 and
    wherein said Ig-derived second binding domain is a scFv.

2. The cytotoxically active CD3 specific binding construct of claim 1 further comprising in said first domain a framework H3 comprising the sequence Met-Glu-Leu-Ser (MELS; SEQ ID NO.: 234).

3. The cytotoxically active CD3 specific binding construct of claim 1 further comprising in said first domain a framework H3 comprising the sequence Ile-Thr-Thr-Asp-Lys (ITTDK; SEQ ID NO.: 235).

4. The CD3 specific binding construct of claim 1, wherein said first domain which specifically binds to human CD3 comprises a framework H1 as shown in SEQ ID NO.: 152 or 153.

5. The CD3 specific binding construct of claim 1, wherein said first domain which specifically binds to human CD3 comprises a framework H2 as shown in SEQ ID NO.: 156 or 157.

6. The CD3 specific binding construct of claim 1, wherein said first domain which specifically binds to human CD3 comprises a framework H3 as shown in SEQ ID NO.: 160 or 161.

7. The CD3 specific binding construct of claim 1, wherein said first domain which specifically binds to human CD3 comprises a framework H4 as shown in SEQ ID NO.: 164 or 165.

8. The CD3 specific binding construct of claim 1, wherein said construct comprises a $V_H$-region as depicted in SEQ ID NO.:74 or 76.

9. The CD3 specific binding construct of claim 1, comprising a $V_L$ region in its CD3-specific portion, wherein said $V_L$ region is selected from the group consisting of SEQ ID NO.: 78, SEQ ID NO.: 80, SEQ ID NO.: 82 and SEQ ID NO.: 112.

10. The CD3 specific binding construct of claim 1, wherein said Ig-derived second domain and/or (a) connecting linker-region(s) is/are humanized and/or deimmunized.

11. The CD3 specific binding construct of claim 1, wherein said Ig-derived second domain comprises an antigen-interaction-site with specificity for a cell surface molecule.

12. The CD3 specific binding construct of claim 11, wherein said cell surface molecule is a tumor specific marker.

13. The CD3 specific binding construct of claim 1, wherein said second Ig-derived binding domain comprises an antigen-interaction site with a specificity for EpCAM.

14. The CD3 specific binding construct of claim 13, wherein said CD3-specific binding construct comprises an amino acid sequence selected from the group of
    (a) an amino acid sequence as shown in any one of SEQ ID NO.: 31, 33, 35, 37, 39, 49, 55, 58, 61, 63, 65, 67, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323 and 325;
    (b) an amino acid sequence encoded by a nucleic acid sequence as shown in any one of SEQ NO.: 30, 32, 34, 36, 38, 48, 54, 57, 60, 62, 64, 66, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322 and 324; and
    (c) an amino acid sequence encoded by a nucleic acid sequence which is degenerate as a result of the genetic code to a nucleotide sequence of (b).

15. The CD3 specific binding construct of claim 1, wherein said Ig-derived second binding domain comprises an antigen-interaction site with a specificity CCR5.

16. The CD3 specific binding construct of claim 15, wherein said CD3-specific binding construct comprises an amino acid sequence selected from the group of
   (a) an amino acid sequence as shown in any one of SEQ ID NO.: 206, 208, 210, 212, 214 or 216;
   (b) an amino acid sequence encoded by a nucleic acid sequence as shown in any one of in SEQ ID NO.: 205, 207, 209, 211, 213 or 215; and
   (c) an amino acid sequence encoded by a nucleic acid sequence which is degenerate as a result of the genetic code to a nucleotide sequence of (b).

17. The CD3 specific binding construct of claim 1, wherein said Ig-derived second binding domain comprises an antigen-interaction site with a specificity for CD19.

18. The CD3 specific binding construct of claim 17, wherein said CD3-specific binding construct comprises an amino acid sequence selected from the group of
   (a) an amino acid sequence as shown in any one of SEQ ID NO.: 190, 192, 194, 196, 198, 200, 327, 329, 331, 333, 335, 337, 339, 341, 343, 345, 347, 349, 351, 353, 357, 359, 361, 363, 365, 367, 369, 371, 373, 375, 377, 379, 381, 383, 385, 387, 389, 391, 393, 395, 397, 399, 401, 403, 405, 407 or 409;
   (b) an amino acid sequence encoded by a nucleic acid sequence as shown in any one of in SEQ ID NO.: 189, 191, 193, 195, 197, 199, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406 or 408; and
   (c) an amino acid sequence encoded by a nucleic acid sequence which is degenerate as a result of the genetic code to a nucleotide sequence of (b).

19. The CD3 specific binding construct of claim 1, wherein said Ig-derived second binding domain comprises an antigen-interaction site with a specificity for CD20.

20. The CD3 specific binding construct of claim 19, wherein said CD3-specific binding construct comprises an amino acid sequence selected from the group of
   (a) an amino acid sequence as shown in any one of SEQ ID NO.: 218, 220, 222, 224, 226, or 228;
   (b) an amino acid sequence encoded by a nucleic acid sequence as shown in any one of in SEQ ID NO.: 217, 219, 221, 223, 225 or 227; and
   (c) an amino acid sequence encoded by a nucleic acid sequence which is degenerate as a result of the genetic code to a nucleotide sequence of (b).

21. A composition comprising
   a CD3 specific binding construct of claim 1, and,
   optionally, a proteinaceous compound capable of providing an activation signal for immune effector cells.

22. The composition of claim 21, which is a pharmaceutical composition further comprising, optionally, suitable formulations of carrier, stabilizers and/or excipients.

23. The composition of claim 21, which is a diagnostic composition further comprising, optionally, means and methods for detection.

24. A kit comprising a CD3 specific binding construct of claim 1, a nucleic acid molecule encoding a CD3 specific binding construct of claim 1, a vector comprising a nucleic acid sequence encoding a CD3 specific binding construct of claim 1, or a host transformed or transfected with a vector comprising a nucleic acid sequence encoding a CD3 specific binding construct of claim 1.

25. A composition comprising
   a) a nucleic acid molecule encoding a CD3 specific binding construct of claim 1, or
   b) a vector comprising a nucleic acid sequence encoding a CD3 specific binding construct of claim 1, or
   c) a host transformed or transfected with a vector comprising a nucleic acid sequence encoding a CD3 specific binding construct of claim 1,
   and,
optionally, a proteinaceous compound capable of providing an activation signal for immune effector cells.

26. The composition of claim 25, which is a diagnostic composition further comprising, optionally, means and methods for detection.

27. A process for the production of a CD3 specific binding construct of claim 1, said process comprising
   culturing a host transformed or transfected with a vector comprising a nucleic acid sequence encoding a CD3 specific binding construct of claim 1 under conditions allowing the expression of the polypeptide construct and recovering the produced polypeptide construct from the culture.

28. A method for the treatment or amelioration of a proliferative disease, a tumorous disease, an inflammatory disease, an immunological disorder, an autoimmune disease, an infectious disease, viral disease, allergic reactions, parasitic reactions, graft-versus-host diseases or host-versus-graft diseases comprising the administration of a CD3 specific binding construct of claim 1 to a subject in need of such a treatment or amelioration.

29. The method of claim 28, wherein said subject is a human.

30. The method of claim 28, further comprising, the administration of a proteinaceous compound capable of providing an activation signal for immune effector cells.

31. The method of claim 30, wherein said proteinaceous compound is administered simultaneously or non-simultaneously with the CD3 specific binding construct.

* * * * *